(12) United States Patent
Askew et al.

(10) Patent No.: US 7,514,594 B2
(45) Date of Patent: Apr. 7, 2009

(54) TRANSGENIC ANIMAL MODEL OF BONE MASS MODULATION

(75) Inventors: G. Roger Askew, Boxford, MA (US); Philip Babij, Dunstable, MA (US); Frederick James Bex, III, Newton Square, PA (US); Peter Van Nest Bodine, Havertown, PA (US)

(73) Assignee: Wyeth, Madison, NJ (US)

( * ) Notice: Subject to any disclaimer, the term of this patent is extended or adjusted under 35 U.S.C. 154(b) by 189 days.

(21) Appl. No.: 10/680,287

(22) Filed: Oct. 8, 2003

(65) Prior Publication Data

US 2004/0244069 A1  Dec. 2, 2004

(51) Int. Cl.
| | |
|---|---|
| A01K 67/00 | (2006.01) |
| A01K 67/033 | (2006.01) |
| A01K 67/027 | (2006.01) |
| C12N 5/00 | (2006.01) |
| C12N 5/02 | (2006.01) |
| C12N 5/06 | (2006.01) |
| C12N 5/10 | (2006.01) |

(52) U.S. Cl. ............... 800/18; 800/8; 800/9; 800/13; 800/14; 435/325; 435/354

(58) Field of Classification Search ............ 800/3, 800/9, 8, 13, 14, 18; 435/325, 354
See application file for complete search history.

(56) References Cited

U.S. PATENT DOCUMENTS

| | | | |
|---|---|---|---|
| 5,691,153 A | 11/1997 | Recker et al. | |
| 6,545,137 B1 | 4/2003 | Todd et al. | |
| 6,555,654 B1 | 4/2003 | Todd et al. | |
| 6,586,655 B2 | 7/2003 | Arbeit et al. | 800/3 |
| 6,770,461 B1 * | 8/2004 | Carulli et al. | 435/70.1 |

FOREIGN PATENT DOCUMENTS

| | | |
|---|---|---|
| WO | WO 97/12903 | 4/1997 |
| WO | WO 98/46743 | 10/1998 |
| WO | WO 98/46743 A | 10/1998 |
| WO | WO 99/09054 | 2/1999 |
| WO | WO 99/47529 | 9/1999 |
| WO | WO 00/58496 A | 10/2000 |
| WO | WO 01/77327 A | 10/2001 |
| WO | WO 01/92891 A | 12/2001 |
| WO | WO 01/98508 A | 12/2001 |
| WO | WO 02/092000 A | 11/2002 |

OTHER PUBLICATIONS

Cameron 1997, Molecular Biotechnology, 7: 253-265.*
Mench 1999, Transgenic Animals in Agriculture, eds. Murray et al., CAB International: Oxon, pp. 251-268.*
Cowan et al. 2003, Xenotransplantation, 10: 223-231.*
Agrawal and Kanimalla 2000, Molecular Medicine Today, 61: 72-81.*
Hammer, et al. 1990, Cell 63:1099-1112.*
Watson et al. 1993, "The Introduction of Foreign Genes into Mice," Molecular Biology of Watson Recombinant DNAs, 2nd Edition, p. 255-272.*
Elbrecht, et al., 1987, Molecular and Cellular Biology, 7: 1276-1279.*
Abdallah et al., 1995, Biol. Cell., 85: 1-7.*
Somia and Verma, 2000, Nature Reviews: Genetics, 1: 91-99.*
Fenske, et al., 2001, Current Opinion in Molecular Therapeutics, 3: 153-158.*
Platt, 1998, Nature, 392 supplement: 11-17.*
Gage, 1998, Nature, 392 supplement, pp. 18-24.*
Fisher, 1997, Neurobiology of Disease, 4: 1-22.*
Genbank [online], 2006 [retrieved on Jun. 30, 2006]. Retrieved from the Internet:< URL: http://www.ncbi.nlm.nih.gov/entrez/viewer.fcgi?db=protein&val=6678716>, pp. 1-5.*
GenBank [online], [retrieved on Jun. 30, 2006]. Retrieved from the Internet:< URL: http://www.ncbi.nlm.nih.gov/entrez/viewer.fcgi?db=protein&val=4505017>, pp. 1-5.*
Hammer et al. 1986, J. of Anim. Sci., 63: 269-278.*
The American Heritage Dictionary of the English Language, 4th Edition [online], 2000 [retrieved on Jun. 30, 2006]. Retrieved from the Internet:<URL:http://dictionary.reference.com/browse/rodent >, pp. 1-2.*
Xu et al., 2001, Gene 272: 149-156.*
Vaisman et al., 2001, J. Clinical Investigation, 108: 303-309.*
European Search Report dated May 12, 2004.
U.S. Appl. No. 09/544,398, filed Apr. 5, 2000, Carulli et al.
U.S. Appl. No. 09/543,771, filed Apr. 5, 2000, Carulli et al.
U.S. Appl. No. 09/578,900, filed May 26, 2000, Carulli et al.
U.S. Appl. No. 10/240,851, filed Oct. 4, 2002, Carulli et al.
U.S. Appl. No. 10/477,173, filed Nov. 10, 2003, Allen et al.
U.S. Appl. No. 10/477,238, filed Apr. 12, 2004, Babij et al.
U.S. Appl. No. 10/374,979, filed Feb. 28, 2003, Carulli et al.
U.S. Appl. No. 10/731,739, filed Dec. 10, 2003, Carulli et al.
U.S. Appl. No. 10/834,377, filed Apr. 29, 2004, Carulli et al.

(Continued)

Primary Examiner—Joanne Hama
(74) Attorney, Agent, or Firm—Drinker Biddle & Reath LLP

(57) ABSTRACT

The present invention relates to methods and materials used to express the HBM protein in animal cells and transgenic animals. The present invention also relates to transgenic animals expressing the high bone mass gene, the corresponding wild-type gene, and mutants thereof. The invention provides nucleic acids, including coding sequences, oligonucleotide primers and probes, proteins, cloning vectors, expression vectors, transformed hosts, methods of developing pharmaceutical compositions, methods of identifying molecules involved in bone development, and methods of diagnosing and treating diseases involved in bone development. In preferred embodiments, the present invention is directed to methods for treating, diagnosing and preventing osteoporosis.

15 Claims, 61 Drawing Sheets

OTHER PUBLICATIONS

Y. Gong et al., "Osteopororis-Pseudoglioma Syndrome, a Disorder Affecting Skeletal Strength and Vision, is Assigned to Chromosome Region 11Q12-13," *American Journal of Human Genetics* (Jul. 1996) pp. 146-151, 59:1, American Society of Human Genetics, Chicago, Illinois, USA.

Johnson et al., "*The Gene for High Bone Mass*," Endocrinologist, vol. 12, No. 5, 2002, pp. 445-453, Lippincott Williams & Wilkins, Philadelphia PA.

Annex Form PCT/ISA/206 Communication Relating to the Results of the Partial International Search attached to Invitation to Pay Additional Fees dated May 7, 2001 in PCT/US00/16951 filed on Jun. 21, 2000.

A. Courseaux et al., "*Homo Sapiens Chromosome 11 Clone BAC67-M-5 MAP 11q13, Sequencing in Progress, 3 Ordered Pieces*", Database EM_HTG, E.B.I., Hinxton, U.K., Accession No. AC024123, Mar. 2, 2000, XP002165276, Abstract.

D.L. Koller et al., "*Linkage of a QTL Contributing to Normal Variation in Bone Mineral Density to Chromosome 11q12-13*", J. Bone Miner. Res., vol. 13, No. 12, pp. 1903-1908, Dec. 1998, Blackwell Science, Inc., American Society for Bone and Mineral Research, USA.

Michael P. Whyte, "*Searching for Gene Defects that Cause High Bone Mass*", Am. J. Hum. Genet., vol. 60; No. 6, pp. 1309-1311, Jun. 1997, The American Society of Human Genetics, USA.

Marion Trommsdorff et al., "*Interaction of Cytosolic Adaptor Proteins with Neuronal Apolipoprotein E Receptors and the Amyloid Precursor Protein*", J. Biol. Chem., vol. 273, No. 50, pp. 33556-33560, Dec. 1998, The American Society for Biochemistry and Molecular Biology, Inc., USA.

G. Schneider et al., "*Formation of Focal Adhesions by Osteoblasts Adhering to Different Substrata*", Experimental Cell Research, vol. 214, No. 1, pp. 264-269, Sep. 1994, Academic Press, Inc., USA.

Frederick M. Pavalko et al., "*Fluid Shear-Induced Mechanical Signaling in MC3T3-E1 Osteoblasts Requires Cytoskeleton-Integrin Interactions*", Am. J. Physiol., vol. 275, No. 6 (Pt1), pp. C1591-1601, Dec. 1998, The American Physiological Society, USA.

Mark L. Johnson et al., "*Linkage of a Gene Causing High Bone Mass to Human Chromosome 11 (11q12-13)*", Am. J. Hum. Genet., vol. 60, No. 6, pp. 1326-1332, Jun. 1997, The American Society of Human Genetics, USA.

Dong-Ho Kim et al., "*A New Low Density Lipoprotein Receptor Related Protein, LRP5, is Expressed in Hepatocytes and Adrenal Cortex, and Recognizes Apolipoprotein E*", J. Biochem., vol. 124, No. 6, pp. 1072-1076, Dec. 1998, The Japanese Biochemical Society, Japan.

Johnson et al., Journal of Bone and Mineral Research, 11 (Supplement 1):S255, abstract S661, Aug. 1996.

Nakagawa et al., American Journal of Human Genetics, 63:547-56 (1998).

Hey et al., "*Cloning of a novel member of the low-density lipoprotein receptor family*", Gene 216: 103-11 (1998).

Dong et al., Biochemical and Biophysical Research Communication, 251: 784-90 (1998).

Bollag et al., "*Osteoblast-derived cells express functional glucose-dependent insulinotropic peptide receptors*", 2000, Endocrinology, vol. 141, pp. 1228-1235.

Ziegler et al., "*Glucocorticoid-induced osteoporosis: Prevention and treatment*", 1998, Steroids, vol. 63, pp. 344-348.

Kundu et al.., Role of Polypeptides in the treatment and diagnosis of osteoporosis, 1999, Peptides, vol. 20, pp. 523-537.

Rodan et al., *Therapeutic approaches to bone diseases*, 2000, Science, vol. 289, pp. 1508-1514.

Bafico et al., "*Novel mechanism of Wnt signalling inhibition mediated by Dickopf-1 Interaction with Irp6/Arrow*", Nature Cell Biology, Jul. 2001, vol. 3, pp. 683-686.

Gong et al., "*LDL receptor-related protein 5 (LRP5) affects bone accrual and eye development*", Cell, vol. 107, pp. 513-523, Nov. 16, 2001, Cell Press.

Mitchell et al., "*Functional analysis of secreted and transmembrane proteins critical to mouse development*", Nature Genetics, Jul. 2001, vol. 28, pp. 241-249.

Pinson et al., "*An LDL-receptor-related protein mediates Wnt signalling in mice*", Nature, Sep. 28, 2000, vol. 407, pp. 535-538.

Tamai et al., "*LDL-receptor-related proteins in Wnt signal transduction*", Nature, vol. 407, pp. 530-535, Sep. 28, 2000, MacMillian Magazines Ltd.

Wehrli et al., "*Arrow encodes and LDL-receptor-related protein essential for Wingless signalling*", Nature, Sep. 28, 2000, vol. 407, pp. 527-530.

Randall D. Little et al., "*A mutation in the LDL Receptor-Related Protein 5 Gene Results in the Autososomal Dominant High-Bone-Mass Trait*", The American Journal of Human Genetics, vol. 70, No. 1, pp. 513-523, Jan. 2002, by The University of Chicago Press. Chicago.

Julian Zielenski, "*Genotype and Phenotype in Cystic Fibrosis*", Respiration, vol. 67, pp. 117-133, 2000, by S. Karger AG, Basel.

Web Page, Abstract for Research News, "*Researchers Discover 'Thermostat' that Regulates Bone Density*", Howard Hughes Medical Institute, Nov. 16, 2001, Chevy Chase, Maryland. At http://www.hhmi.org/news/warman.html.

Robert E. Hammer et al., 1990, "Spontaneous inflammatory disease in transgenic rats expressing HLA-B27 and human $\beta_2$m: An aminal model of HLA-B27-associated human disorders," Cell 63: 1099-1112.

P.J. Cowan et al., 2003, "Targeting gene expression to endothelium in transgenic animals: a comparison of the human ICAM-2, PECAM-1 and endoglin promoters," *Xenotransplantation* 10: 223-231.

Kevin R. Smith, 2004, "Gene Therapy: The Potential Applicability of Gene Transfer Technology to the Human Germline," Int. J. Med. Sci. 1(2): 76-91.

R. L. Page et al., 1995, "Transgene detection during early murine embryonic development after pronuclear microinjection," *Transgenic Research*, 4: 12-17.

Jerome Rossert, et al., 1996, "Indentification of a minimal sequence of the mouse pro-$\alpha$1(I) collagen promoter that confers high-level osteoblast expression in transgenic mice and that binds a protein selectively present in osteoblasts," Proc. Nat'l Acad. Sci. USA 93: 1027-1031.

Donald B. Kimmel, "Animal Models in Osteoporosis Research," In Principles of Bone Biology, 1635-1655 (John P. Bilezikian et al., eds. 2nd ed. California 2002).

Hey et al., 1998 "Cloning of a novel member of the low-density lipoprotein receptor family," Gene 216: 103-111.

Magoori et al., 2003 "Severe Hypercholesterolemia, impaired fat tolerance, and advanced atherosclerosis in mice lacking both low density lipoprotein receptor-related protein 5 and apolipoprotein E," J. Biol. Chem. 278: 11331-11336.

Fujino et al., 2003 "Low-density lipoprotein receptor-related protein 5 (LRP5) is essential for normal cholesterol metabolism and glucose-induced insulin secretion," Proc. Nat'l Acad. Sci USA 100: 229-234.

Online Mendelian Inheritance in Man, "*Low Density Lipoprotein Receptor-Related Protein 5, LRP5*"; Accession No. 603506; Created by Sheryl A. Jankowski on Feb. 9, 1999; Johns Hopkins University 1966-2006 [retrieved on Mar. 3, 2006]. Retrieved from the Internet: <URL: http://www.ncbi.nlm.nih.gov/entrez/dispomim.cgi?id=603506>.

P. Racay, "Genetically Modified Animals and Human Medicine," *Bratisl Lek Listy*, 103: 121-126 (2002).

R. Jakel et al., "Using Human Neural Stem Cells to Model Neurological Disease," *Nature Reviews Genetics* 5: 136-144 (2004).

R. Inagi et al., "Novel Serpinopathy in Rat Kidney and Pancreas Induced by Overexpression of Megsin," J. Am. Soc. Nephrol. 16: 1339-1349 (2005).

T. Miyata et al., "Overexpression of the Serpin Megsin Induces Progressive Mesangial Cell Proliferation and Expansion," J. Clin. Invest. 109: 585-593 (2002).

S.P. Bruder et al., "Monocloncal Antibodies Reactive with Human Osteogenic Cell Surface Antigens," *Bone* 21(3): 225-235 (1997).

* cited by examiner

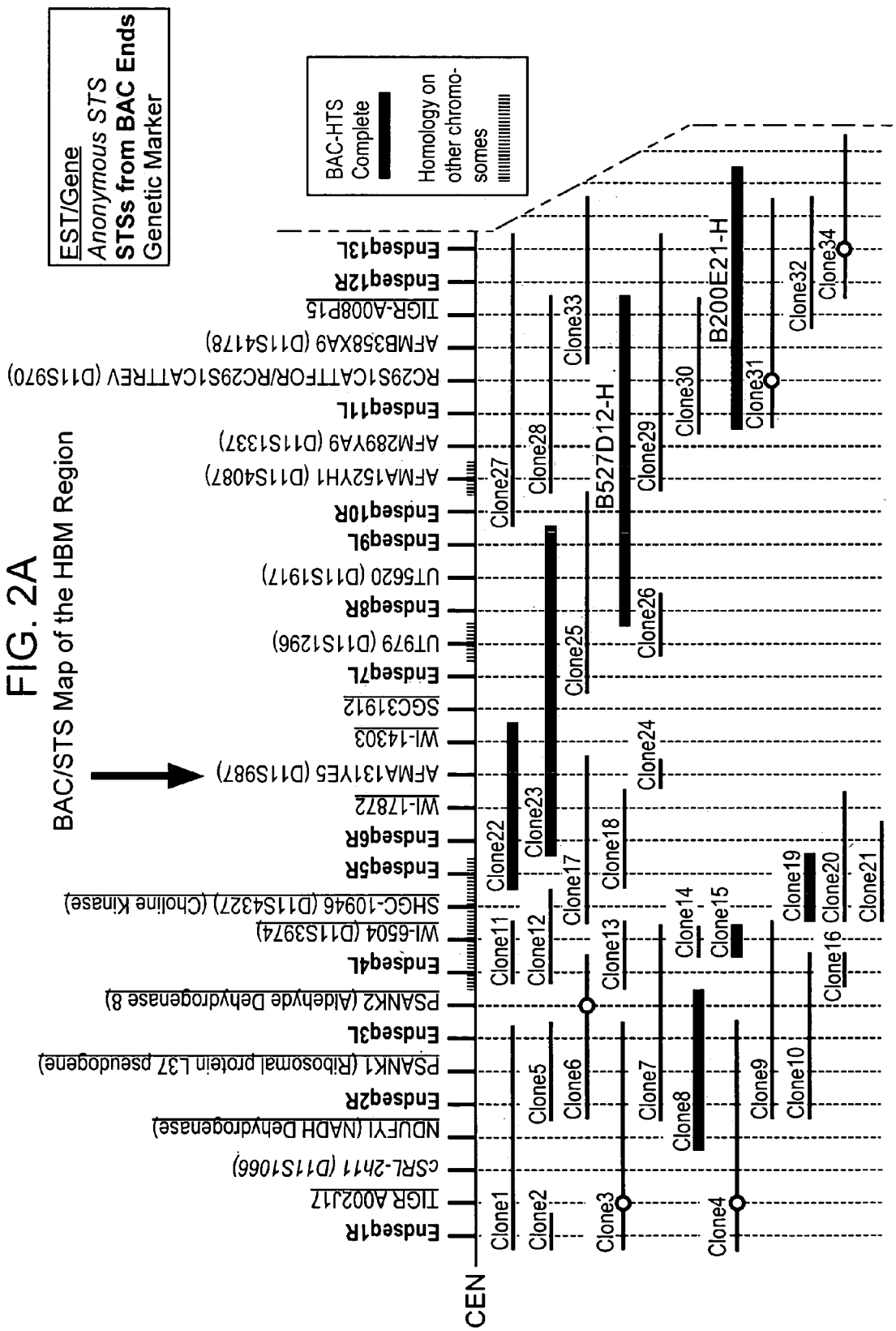

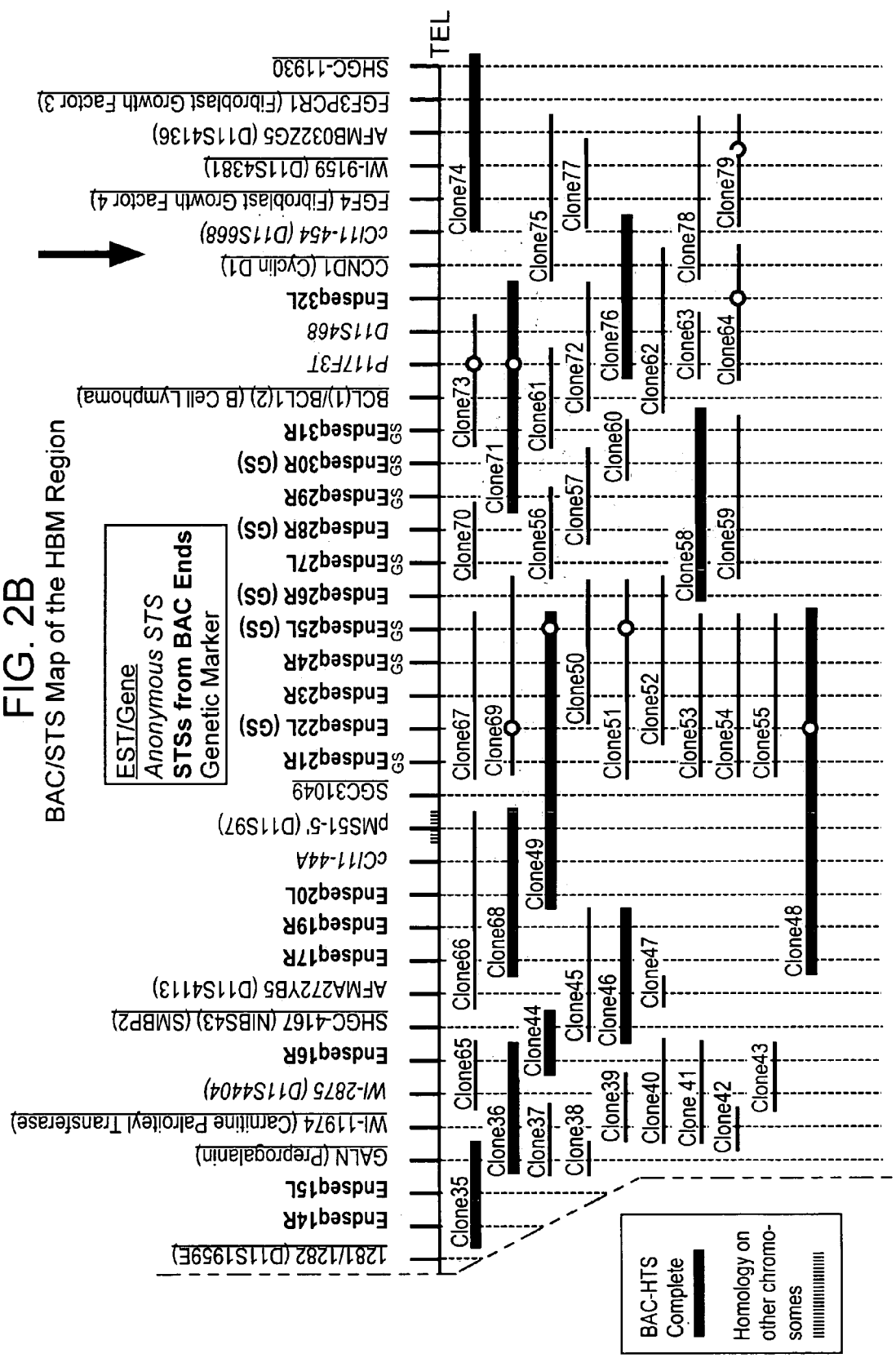

Exon 1
ACTAAAGCGCCGCCGCCGCGCCATGGAGCCCGAGTGAGCGCGGCGCGG
GCCCGTCCGGCCGCCGGACAACATGGAGGCAGCGCCGCCCGGGCCGCC
GTGGCCGCTGCTGCTGCTGCTGCTGCTGCTGGCGCTGTGCGGCTGC
CCGGCCCCCGCCGCGGCC

Exon 2 Coordinates: 527d12_Contig308G 30944-30549
gccccacagCCTCGCCGCTCCTGCTATTTGCCAACCGCCGGGACGTACGGCT
GGTGGACGCCGGCGGAGTCAAGCTGGAGTCCACCATCGTGGTCAGCGG
CCTGGAGGATGCGGCCGCAGTGGACTTCCAGTTTTCCAAGGGAGCCGTG
TACTGGACAGACGTGAGCGAGGAGGCCATCAAGCAGACCTACCTGAACC
AGACGGGGGCCGCCGTGCAGAACGTGGTCATCTCCGGCCTGGTCTCTCC
CGACGGCCTCGCCTGCGACTGGGTGGGCAAGAAGCTGTACTGGACGGA
CTCAGAGACCAACCGCATCGAGGTGGCCAACCTCAATGGCACATCCGG
AAGGTGCTCTTCTGGCAGGACCTTGACCAGCCGAGGGCCATCGCCTTGG
ACCCCGCTCACGGgtaaaccctgctg ... 9408 nt ...

Exon 3 Coordinates: 527d12_Contig308G 21141-20945
ccccgtcacagGTACATGTACTGGACAGACTGGGGTGAGACGCCCCGGATTGA
GCGGGCAGGGATGGATGGCAGCACCCGGAAGATCATTGTGGACTCGGA
CATTTACTGGCCCAATGGACTGACCATCGACCTGGAGGAGCAGAAGCTC
TACTGGGCTGACGCCAAGCTCAGCTTCATCCACCGTGCCAACCTGGACG
GCTCGTTCCGgtaggtacccac ... 6094 nt ...

Exon 4 Coordinates: 527d12_Contig308G 15047-14850
tccctgactgcagGCAGAAGGTGGTGGAGGGCAGCCTGACGCACCCCTTCGCCC
TGACGCTCTCCGGGGACACTCTGTACTGGACAGACTGGCAGACCCGCTC
CATCCATGCCTGCAACAAGCGCACTGGGGGGAAGAGGAAGGAGATCCTG
AGTGCCCTATACTCACCCATGGACATCCAGGTGCTGAGCCAGGAGCGGC
AGCCTTTCTgtgagtgccgg ... 1827 nt ...

Exon 5 Coordinates: 527d12_Contig308G 13220-13088
tttctcagTCCACACTCGCTGTGAGGAGGACAATGGCGGCTGCTCCCACCTGT
GCCTGCTGTCCCCAAGCGAGCCTTTCTACACATGCGCCTGCCCCACGGG
TGTGCAGCTGCAGGACAACGGCAGGACGTGTAAGGCAGgtgaggcggtgggacg

Exon 6 Coordinates: 527d12_Contig309G 7705-8100
ctccacagGAGCCGAGGAGGTGCTGCTGCTGGCCCGGCGGACGGACCTACG
GAGGATCTCGCTGGACACGCCGGACTTCACCGACATCGTGCTGCAGGTG
GACGACATCCGGCACGCCATTGCCATCGACTACGACCCGCTAGAGGGCT
ATGTCTACTGGACAGATGACGAGGTGCGGGCCATCCGCAGGGCGTACCT
GGACGGGTCTGGGGCGCAGACGCTGGTCAACACCGAGATCAACGACCC
CGATGGCATCGCGGTCGACTGGGTGGCCCGAAACCTCTACTGGACCGAC
ACGGGCACGGACCGCATCGAGGTGACGCGCCTCAACGGCACCTCCCGCA
AGATCCTGGTGTCGGAGGACCTGGACGAGCCCCGAGCCATCGCACTGCA
CCCCGTGATGGGgtaagacgggc ..... 3211 nt .....

Exon 7 Coordinates: 527d12_Contig309G 11311-11482
ttcttctccagCCTCATGTACTGGACAGACTGGGGAGAGAACCCTAAAATCGAG
TGTGCCAACTTGGATGGGCAGGAGCGGCGTGTGCTGGTCAATGCCTCCC
TCGGGTGGCCCAACGGCCTGGCCCTGGACCTGCAGGAGGGGAAGCTCT
ACTGGGGAGACGCCAAGACAGACAAGATCGAGgtgaggctcctgtgg ...... 13445 nt .....

Exon 8 Coordinates: 527d12_Contig309G 24927-25143
ccgtcctgcagGTGATCAATGTTGATGGGACGAAGAGGCGGACCCTCCTGGAG
GACAAGCTCCCGCACATTTTCGGGTTCACGCTGCTGGGGGACTTCATCT
ACTGGACTGACTGGCAGCGCCGCAGCATCGAGCGGGTGCACAAGGTCAA
GGCCAGCCGGGACGTCATCATTGACCAGCTGCCCGACCTGATGGGGCTC
AAAGCTGTGAATGTGGCCAAGGTCGTCGgtgagtccgggggtc ....2826 nt ......

Exon 9 Coordinates: 527d12_Contig309G 27969-28256
gttcgcttccagGAACCAACCCGTGTGCGGACAGGAACGGGGGGTGCAGCCACC
TGTGCTTCTTCACACCCCACGCAACCCGGTGTGGCTGCCCCATCGGCCT
GGAGCTGCTGAGTGACATGAAGACCTGCATCGTGCCTGAGGCCTTCTTG
GTCTTCACCAGCAGAGCCGCCATCCACAGGATCTCCCTCGAGACCAATA
ACAACGACGTGGCCATCCCGCTCACGGGCGTCAAGGAGGCCTCAGCCCT
GGACTTTGATGTGTCCAACAACCACATCTACTGGACAGACGTCAGCCTG
AAGgtagcgtgggc

Exon 10 Coordinates: 527d12_Contig309G 31358-31582
cctgctgccagACCATCAGCCGCGCCTTCATGAACGGGAGCTCGGTGGAGCAC
GTGGTGGAGTTTGGCCTTGACTACCCCGAGGGCATGGCCGTTGACTGGA
TGGGCAAGAACCTCTACTGGGCCGACACTGGGACCAACAGAATCGAAGT
GGCGCGGCTGGACGGGCAGTTCCGGCAAGTCCTCGTGTGGAGGGACTT
GGACAACCCGAGGTCGCTGGCCCTGGATCCCACCAAGGGgtaagtgtttgcctgtc ......1297 nt......

Exon 11 Coordinates: 527d12_Contig309G 32879-33064
gtgccttccagCTACATCTACTGGACCGAGTGGGGCGGCAAGCCGAGGATCGT
GCGGGCCTTCATGGACGGGACCAACTGCATGACGCTGGTGGACAAGGTG
GGCCGGGCCAACGACCTCACCATTGACTACGCTGACCAGCGCCTCTACT
GGACCGACCTGGACACCAACATGATCGAGTCGTCCAACATGCTGGgtgaggg
ccgggct .......2069 nt.....

Exon 12 Coordinates: 527d12_Contig309G 35133-35454
gtgttcatgcagGTCAGGAGCGGGTCGTGATTGCCGACGATCTCCCGCACCCGT
TCGGTCTGACGCAGTACAGCGATTATATCTACTGGACAGACTGGAATCT
GCACAGCATTGAGCGGGCCGACAAGACTAGCGGCCGGAACCGCACCCTC
ATCCAGGGCCACCTGGACTTCGTGATGGACATCCTGGTGTTCCACTCCT
CCCGCCAGGATGGCCTCAATGACTGTATGCACAACAACGGGCAGTGTGG
GCAGCTGTGCCTTGCCATCCCCGGCGGCCACCGCTGCGGCTGCGCCTCA
CACTACACCCTGGACCCCAGCAGCCGCAACTGCAGCCgtaagtgcctcatggt .......2006 nt......

Exon 13 Coordinates: 527d12_Contig309G 37460-37659
gcctcctctaCGCCCACCACCTTCTTGCTGTTCAGCCAGAAATCTGCCATCAGT
CGGATGATCCCGGACGACCAGCACAGCCCGGATCTCATCCTGCCCCTGC
ATGGACTGAGGAACGTCAAAGCCATCGACTATGACCCACTGGACAAGTT
CATCTACTGGGTGGATGGGCGCCAGAACATCAAGCGAGCCAAGGACGAC
GGGACCCAGgcaggtgccctgtgg ......6965 nt......

FIG. 3C

Exon 14 Coordinates: 527d12_Contig309G 44624-44832
ctttgtcttacagCCCTTTGTTTTGACCTCTCTGAGCCAAGGCCAAAACCCAGACA
GGCAGCCCCACGACCTCAGCATCGACATCTACAGCCGGACACTGTTCTG
GACGTGCGAGGCCACCAATACCATCAACGTCCACAGGCTGAGCGGGGAA
GCCATGGGGGTGGTGCTGCGTGGGGACCGCGACAAGCCCAGGGCCATC
GTCGTCAACGCGGAGCGAGGgtaggaggccaac ......1404 nt.....

Exon 15 Coordinates: 527d12_Contig309G 46236-46427
ccaccctcccgcagGTACCTGTACTTCACCAACATGCAGGACCGGGCAGCCAAGA
TCGAACGCGCAGCCCTGGACGGCACCGAGCGCGAGGTCCTCTTCACCAC
CGGCCTCATCCGCCCTGTGGCCCTGGTGGTGGACAACACACTGGGCAAG
CTGTTCTGGGTGGACGCGGACCTGAAGCGCATTGAGAGCTGTGACCTGT
CAGgtacgcgccccgg .....686 nt.....

Exon 16 Coordinates: 527d12_Contig309G 47113-47322
ggctgcttgcagGGGCCAACCGCCTGACCCTGGAGGACGCCAACATCGTGCAGC
CTCTGGGCCTGACCATCCTTGGCAAGCATCTCTACTGGATCGACCGCCA
GCAGCAGATGATCGAGCGTGTGGAGAAGACCACCGGGGACAAGCGGAC
TCGCATCCAGGGCCGTGTCGCCCACCTCACTGGCATCCATGCAGTGGAG
GAAGTCAGCCTGGAGGAGTTCTgtacgtgggggc .....3884 nt......

Exon 17 Coordinates: 527d12_Contig309G 51206-51331
ttgtctttgcagCAGCCCACCCATGTGCCCGTGACAATGGTGGCTGCTCCCACAT
CTGTATTGCCAAGGGTGATGGGACACCACGGTGCTCATGCCCAGTCCAC
CTCGTGCTCCTGCAGAACCTGCTGACCTGTGGAGgtaggtgtgacctaggtgc ....3905 nt.......

Exon 18 Coordinates: 527d12_Contig309G 55236-55472
gttctcctctgtccctcccccagAGCCGCCCACCTGCTCCCCGGACCAGTTTGCATGTG
CCACAGGGGAGATCGACTGTATCCCCGGGGCCTGGCGCTGTGACGGCTT
TCCCGAGTGCGATGACCAGAGCGACGAGGAGGGCTGCCCCGTGTGCTCC
GCCGCCCAGTTCCCCTGCGCGCGGGGTCAGTGTGTGGACCTGCGCCTGC
GCTGCGACGGCGAGGCAGACTGTCAGGACCGCTCAGACGAGGTGGACT
GTGACGgtgaggccctcc .......3052 nt.....

FIG. 3D

Exon 19 Coordinates: 527d12_Contig309G 58524-58634
tctccttgcagCCATCTGCCTGCCCAACCAGTTCCGGTGTGCGAGCGGCCAGTG
TGTCCTCATCAAACAGCAGTGCGACTCCTTCCCCGACTGTATCGACGGCT
CCGACGAGCTCATGTGTGgtgagccagctt ........1448 nt......

Exon 20 Coordinates: 527d12_Contig309G 60082-60319
gtttgtctctggcagAAATCACCAAGCCGCCCTCAGACGACAGCCCGGCCCACAGC
AGTGCCATCGGGCCCGTCATTGGCATCATCCTCTCTCTCTTCGTCATGGG
TGGTGTCTATTTTGTGTGCCAGCGCGTGGTGTGCCAGCGCTATGCGGGG
GCCAACGGGCCCTTCCCGCACGAGTATGTCAGCGGGACCCCGCACGTGC
CCCTCAATTTCATAGCCCCGGGCGGTTCCCAGCATGGCCCCTTCACAGgta
aggagcctgagatatggaa ....1095 nt.....

Exon 21 Coordinates: 527d12_Contig309G 61414-61552
cttccctgccagGCATCGCATGCGGAAAGTCCATGATGAGCTCCGTGAGCCTGA
TGGGGGGCCGGGGCGGGGTGCCCCTCTACGACCGGAACCACGTCACAG
GGGCCTCGTCCAGCAGCTCGTCCAGCACGAAGGCCACGCTGTACCCGCC
Ggtgaggggcggg ......6513 nt......

Exon 22 Coordinates: 527d12_Contig309G 68065-68162
ttggctctcctcagATCCTGAACCCGCCGCCCTCCCCGGCCACGGACCCCTCCCT
GTACAACATGGACATGTTCTACTCTTCAAACATTCCGGCCACTGCGAGAC
CGTACAGgtaggacatcccctgcag .......2273 nt.....

FIG. 3E

Exon 23 Coordinates: 527d12_Contig309G 70435-70901
tcaaacattccggccactgcgagaccgtacagGCCCTACATCATTCGAGGAATGGCGCCCCC
GACGACGCCCTGCAGCACCGACGTGTGTGACAGCGACTACAGCGCCAGC
CGCTGGAAGGCCAGCAAGTACTACCTGGATTTGAACTCGGACTCAGACC
CCTATCCACCCCCACCCACGCCCCACAGCCAGTACCTGTCGGCGGAGGA
CAGCTGCCCGCCCTCGCCCGCCACCGAGAGGAGCTACTTCCATCTCTTC
CCGCCCCCTCCGTCCCCCTGCACGGACTCATCCTGACCTCGGCCGGGCCA
CTCTGGCTTCTCTGTGCCCCTGTAAATAGTTTTAAATATGAACAAAGAAAAAA
ATATATTTTATGATTTAAAAAATAAATATAATTGGGATTTTAAAAACATGAGA
AATGTGAACTGTGATGGGGTGGGCAGGGCTGGGAGAACTTTGTACAGTGGAG
AAATATTTATAAACTTAATTTTGTAAAACA

```
1    ACTAAAGCGCCCGCCCGCGCCATGGAGCCCGAGTGAGCCGGGCGCGGGCCCGTCCGGCC           60
61   GCCGGACAACATGGAGGCAGCCCCGGCCCCGCCTGCCGGCCCGCTGCTGCTGCTGCTGCT          120
1                 M  E  A  A  P  P  G  P  P  W  P  L  L  L  L  L  L        17

121  GCTGCTGCTGGCGCTGTGCGGCTGCCCGGCGGCCGCCGCGAGCCCGCTCCTGCTCTATT          180
18    L  L  L  A  L  C  G  C  P  A  A  A  A  S  P  L  L  L  F            37

181  TGCCAACCGCCGGGACGTACGGCGTGGTGGACGCGGCGGGAGTCAAGCTGGAGTCCACCAT        240
38    A  N  R  R  D  V  R  L  V  D  A  G  G  V  K  L  E  S  T  I         57

241  CGTGGTCAGCGGCCTGGAGGATGCGGCCGCAGTGGACTTCCAGTTTTCCAAGGGAGCCGT        300
58    V  V  S  G  L  E  D  A  A  A  V  D  F  Q  F  S  K  G  A  V         77

301  GTACTGGACAGACGTGAGCGAGGAGGCCATCAAGCAGACCTACCTGAACCAGACGGGGGC        360
78    Y  W  T  D  V  S  E  E  A  I  K  Q  T  Y  L  N  Q  T  G  A         97

361  CGCCGTGCAGAACGTGGTCATCTCCGGCCTGGTCTCTCCCGACGGCCTGGCCTGCGACTG        420
98    A  V  Q  N  V  V  I  S  G  L  V  S  P  D  G  L  A  C  D  W        117

421  GGTGGGCAAGAAGCTGTACTGGACGGACTCAGAGACCAACCGCATCGAGGTGGCCAACCT        480
118   V  G  K  K  L  Y  W  T  D  S  E  T  N  R  I  E  V  A  N  L        137

481  CAATGGCACATCCCGGAAGGTGCTCTTCTGGCAGGACCTTGACCTGGAGGCCATCGC          540
138   N  G  T  S  R  K  V  L  F  W  Q  D  L  D  Q  P  P  R  A  I  A     157

541  CTTGGACCCCGCTCACGGGTACATGTACTGGACAGACTGGGGTGAGACGCCCCGGATTGA        600
158   L  D  P  A  H  G  Y  M  Y  W  T  D  W  G  E  T  P  R  I  E       177
```

FIG. 6B

```
601  GCGGGCAGGGATGGATGGCAGCACCCGGAAGATCATTGTGGACTCGGACATTTACTGGCC  660
178   R   A   G   M   D   G   S   T   R   K   I   I   V   D   S   D   I   Y   W   P   197

661  CAATGGACTGACCATCGACCTGGAGGAGCAGAAGCTCTACTGGGCTGACGCCAAGCTCAG  720
198   N   G   L   T   I   D   L   E   E   Q   K   L   Y   W   A   D   A   K   L   S   217

721  CTTCATCCACCGTGCCAACCTGGACGGCTCGTTCCGGCAGAAGGTGGTGGAGGGCAGCCT  780
218   F   I   H   R   A   N   L   D   G   S   F   R   Q   K   V   V   E   G   S   L   237

781  GACGCACCCCCTTCGCCCTGACGCTCTCCGGGGACACTCTGTACTGGACAGACTGGCAGAC  840
238   T   H   P   F   A   L   T   L   S   G   D   T   L   Y   W   T   D   W   Q   T   257

841  CCGCTCCATCCATGCCTGCAACAAGCGCACTGGGGGGAAGAGGAAGGAGATCCTGAGTGC  900
258   R   S   I   H   A   C   N   K   R   T   G   G   K   R   K   E   I   L   S   A   277

901  CCTCTACTCACCCATGGACATCCAGGTGCTGAGCCAGGAGCGGCAGCCTTTCTTCCACAC  960
278   L   Y   S   P   M   D   I   Q   V   L   S   Q   E   R   Q   P   F   F   H   T   297

961  TCGCTGTGAGGAGGACAATGGCGGCTGCTCCCACCTGTGCCTGCTGTCCCCAAGCGAGCC  1020
298   R   C   E   E   D   N   G   G   C   S   H   L   C   L   L   S   P   S   E   P   317

1021 TTTCTACACATGCGCCTGCCCAGGGTGTGCAGGACGTGCAGCTGCAGGACAACGGACGGACGTGTAA  1080
318   F   Y   T   C   A   C   P   T   G   V   Q   L   Q   D   N   G   R   T   C   K   337

1081 GGCAGGAGCCCGAGGAGGTGCTGCTGGCCCGGCGGACCTACGGAGGATCTCGCT  1140
338   A   G   A   E   E   V   L   L   A   R   R   T   D   L   R   R   I   S   L   357
```

FIG. 6C

| | | | |
|---|---|---|---|
| 1141 | GGACACGCCCGACTTCACCGACATCGTGCTGCAGGTGGACGACATCCGGCACGCCATTGC | 1200 | |
| 358  | D   T   P   D   F   T   D   I   V   L   Q   V   D   D   I   R   H   A   I   A | 377 | |
| 1201 | CATCGACTACGACCCGCTAGAGGGCTATGTCTACTGGACAGATGACGAGGTGCGGGCCAT | 1260 | |
| 378  | I   D   Y   D   P   L   E   G   Y   V   Y   W   T   D   D   E   V   R   A   I | 397 | |
| 1261 | CCGCAGGGCGTACCTGGACGGGTCTGGGGCGCAGACGCTGGTCAACACCGAGATCAACGA | 1320 | |
| 398  | R   R   A   Y   L   D   G   S   G   A   Q   T   L   V   N   T   E   I   N   D | 417 | |
| 1321 | CCCCGATGGCATCGCGGTCGACTGGGTGGCCCGAAACCTCTACTGGACCGACACGGGCAC | 1380 | |
| 418  | P   D   G   I   A   V   D   W   V   A   R   N   L   Y   W   T   D   T   G   T | 437 | |
| 1381 | GGACCGCATCGAGGTGACGCGCCTCAACGGCACTCCCGCAAGATCCTGGTGTCGGAGGA | 1440 | |
| 438  | D   R   I   E   V   T   R   L   N   G   T   S   R   K   I   L   V   S   E   D | 457 | |
| 1441 | CCTGGACGAGCCCCGAGCCATCGCACTGCACCCCGTGATGGGCCTCATGTACTGGACAGA | 1500 | |
| 458  | L   D   E   P   R   A   I   A   L   H   P   V   M   G   L   M   Y   W   T   D | 477 | |
| 1501 | CTGGGGAGAGAACCCTAAAATCGAGTGTGCCAACTTGGATGGGCAGGAGCGGCGTGTGCT | 1560 | |
| 478  | W   G   E   N   P   K   I   E   C   A   N   L   D   G   Q   E   R   R   V   L | 497 | |
| 1561 | GGTCAATGCCTCCCTGGGGTGGCCCAACGGCCTGGCCCTGGACCTGCAGGAGGGAAGCT | 1620 | |
| 498  | V   N   A   S   L   G   W   P   N   G   L   A   L   D   L   Q   E   G   K   L | 517 | |
| 1621 | CTACTGGGGAGACGCCAAGACAGACAAGATCGAGGTGATCAATGTTGATGGGACGAAGAG | 1680 | |
| 518  | Y   W   G   D   A   K   T   D   K   I   E   V   I   N   V   D   G   T   K   R | 537 | |

FIG. 6D

```
1681  GCGGACCCCTCCTGGAGGACAAGCTCCCGCACATTTCGGGTTCACGCTGCTGGGGACTT  1740
 538   R  T  L  L  E  D  K  L  P  H  I  F  G  F  T  L  L  G  D  F    557

1741  CATCTACTGGACTGACTGGCAGCGCCGCAGCATCGAGCGGGTGCACAAGGTCAAGGCCAG  1800
 558   I  Y  W  T  D  W  Q  R  R  S  I  E  R  V  H  K  V  K  A  S    577

1801  CCGGGACGTCATCATTGACCAGCTGCCCGACCTGATGGGGCTCAAAGCTGTGAATGTGGC  1860
 578   R  D  V  I  I  D  Q  L  P  D  L  M  G  L  K  A  V  N  V  A    597

1861  CAAGGTCGTCGGAACAAACCCGTGTGCGGACAGGAACGGGGGGTGCAGCCACCTGTGCTT  1920
 598   K  V  V  G  T  N  P  C  A  D  R  N  G  G  C  S  H  L  C  F    617

1921  CTTCACACCCCACGCCAACCCGGTGCCCCATCGGCCTGGAGCTGCTGAGTGACAT  1980
 618   F  T  P  H  A  T  R  C  G  C  P  I  G  L  E  L  L  S  D  M    637

1981  GAAGACCTGCATCGTGCCTGAGGCCTTCTTGGTCTTCACCAGCAGAGCCGCCATCCACAG  2040
 638   K  T  C  I  V  P  E  A  F  L  V  F  T  S  R  A  A  I  H  R    657

2041  GATCTCCCTCGAGACCAATAACAACGACGTGGCCATCCCGCTCACGGGCGTCAAGGAGGC  2100
 658   I  S  L  E  T  N  N  N  D  V  A  I  P  L  T  G  V  K  E  A    677

2101  CTCAGCCCTGGACTTTGATGTGTCCAACAACCACATCTACTGGACAGACGTCAGCCTGAA  2160
 678   S  A  L  D  F  D  V  S  N  N  H  I  Y  W  T  D  V  S  L  K    697

2161  GACCATCAGCCGCGCCTTCATGAACGGGAGCTCGGTGGAGCACGTGGTGGAGTTTGGCCT  2220
 698   T  I  S  R  A  F  M  N  G  S  S  V  E  H  V  V  E  F  G  L    717
```

FIG. 6E

```
2221  TGACTACCCCGAGGGCATGGCCGTTGACTGGATGGGCAAGAACCTCTACTGGGCCGACAC  2280
 718    D  Y  P  E  G  M  A  V  D  W  M  G  K  N  L  Y  W  A  D  T   737

2281  TGGGACCAACAGAATCGAAGTGGCCCGCGTCCTGGACGGGCAGTTCCGGCAAGTCCTCGTG  2340
 738    G  T  N  R  I  E  V  A  R  L  D  G  Q  F  R  Q  V  L  V  W   757

2341  GAGGGACTTGGACAACCCGAGTCGCTGGCCCTGGATCCCACCAAGGGCTACATCTACTG   2400
 758    R  D  L  D  N  P  R  S  L  A  L  D  P  T  K  G  Y  I  Y  W   777

2401  GACCGAGTGGGGCGGCAAGCCGAGGATCGTGCGGGCCTTCATGGACGGGACCAACTGCAT  2460
 778    T  E  W  G  G  K  P  R  I  V  R  A  F  M  D  G  T  N  C  M   797

2461  GACGCTGGTGGACAAGGTGGGCCGGGCCAACGACCTCACCATTGACTACGCTGACCAGCG  2520
 798    T  L  V  D  K  V  G  R  A  N  D  L  T  I  D  Y  A  D  Q  R   817

2521  CCTCTACTGGACCGACCTGGACACCAACATGATCGAGTCGTCCAACATGCTGGGTCAGGA  2580
 818    L  Y  W  T  D  L  D  T  N  M  I  E  S  S  N  M  L  G  Q  E   837

2581  GCGGGTCGTGATTGCCGACGATCTCCCGCACCCGTTCGGTCTGACGCAGTACAGCGATTA  2640
 838    R  V  V  I  A  D  D  L  P  H  P  F  G  L  T  Q  Y  S  D  Y   857

2641  TATCTACTGGACAGACTGGAATCTGCACAGCATTGAGCGGGCCGACAAGACTAGCGGCCG  2700
 858    I  Y  W  T  D  W  N  L  H  S  I  E  R  A  D  K  T  S  G  R   877

2701  GAACCGCACCCTCATCCAGGGCCACCTTGACTTCGTGATGGACATCCTGGTGTTCCACTC  2760
 878    N  R  T  L  I  Q  G  H  L  D  F  V  M  D  I  L  V  F  H  S   897
```

FIG. 6F

```
2761  CTCCCGCCAGGATGGCCTCAATGACTGTATGCACAACAACGGGCAGTGTGGGCAGCTGTG  2820
 898   S   R   Q   D   G   L   N   D   C   M   H   N   N   G   Q   C   G   Q   L   C   917

2821  CCTTGCCATCCCCGGCGGCCACCGTGCGCTGCGCCTCACACTACACCCTGGACCCCCAG   2880
 918   L   A   I   P   G   G   H   R   C   G   C   A   S   H   Y   T   L   D   P   S   937

2881  CAGCCCGCAACTGCAGCCCGCCACCTTCTTGCTCGTGTTCAGCCAGAAATCTGCCATCAG  2940
 938   S   R   N   C   S   P   P   T   F   L   L   F   S   Q   K   S   A   I   S   957

2941  TCGGATGATCCCCGGACGACACAGCCCGGATCTCATCCTGCCCCTGCATGGACTGAG     3000
 958   R   M   I   P   D   D   Q   H   S   P   D   L   I   L   P   L   H   G   L   R   977

3001  GAACGTCAAAGCCATCGACTATGACCCACTGGACAAGTTCATCTACTGGGTGGATGGGCG  3060
 978   N   V   K   A   I   D   Y   D   P   L   D   K   F   I   Y   W   V   D   G   R   997

3061  CCAGAACATCAAGCGAGCCAAGGACGACGGGACCCAGCCCCCAGACCTCAGCATCGACATCTACAGCCGGAC  3120
 998   Q   N   I   K   R   A   K   D   D   G   T   Q   P   F   V   L   T   S   L   S   1017

3121  CCAAGGCCAAAACCCAGACAGGCCCCCACGACCTCAGCATCGACATCTACAGCCGGAC    3180
1018   Q   G   Q   N   P   D   R   Q   P   H   D   L   S   I   D   I   Y   S   R   T   1037

3181  ACTGTTCTGGACGTGCGAGGCCACCAATACCATCAACGTCCACAGGCTGAGCGGGGAAGC  3240
1038   L   F   W   T   C   E   A   T   N   T   I   N   V   H   R   L   S   G   E   A   1057

3241  CATGGGGGTGGTGCTGCGTGGGGACCGCGACAAGCCCAGGGCCATCGTCGTCAACGCGGA  3300
1058   M   G   V   V   L   R   G   D   R   D   K   P   R   A   I   V   V   N   A   E   1077
```

FIG. 6G

```
3301  GCGAGGGTACCTGTACTTCACCAACATGCAGGACCGGGCAGCCAAGATCGAACGCGCAGC  3360
1078    R   G   Y   L   Y   F   T   N   M   Q   D   R   A   A   K   I   E   R   A   A    1097

3361  CCTGGACGGCACCGAGCGCGAGGTCCTCTTCACCGGCCTCATCCGCCCTGTGGCCCT    3420
1098    L   D   G   T   E   R   E   V   L   F   T   T   G   L   I   R   P   V   A   L    1117

3421  GGTGGTGGACAACACTGGGCAAGCTGTTCTGGGTGGACGCGGACCTGAAGCGCATTGA    3480
1118    V   V   D   N   T   L   G   K   L   F   W   V   D   A   D   L   K   R   I   E    1137

3481  GAGCTGTGACCTGTCAGGGGCCAACCGCCTGACCCTGGAGGACGCCAACATCGTGCAGCC    3540
1138    S   C   D   L   S   G   A   N   R   L   T   L   E   D   A   N   I   V   Q   P    1157

3541  TCTGGGCCTGACCATCCTTGGCAAGCATCTCTACTGGATCGACCGCCAGCAGCAGATGAT    3600
1158    L   G   L   T   I   L   G   K   H   L   Y   W   I   D   R   Q   Q   Q   M   I    1177

3601  CGAGCGTGTGGAGAAGACCACCGGGGACAAGCGACTCGCATCCAGGGCCGTGTCGCCCA    3660
1178    E   R   V   E   K   T   T   G   D   K   R   T   R   I   Q   G   R   V   A   H    1197

3661  CCTCACTGGCATCCATGCAGTGGAGGAAGTCAGCCTGGAGGAGTTCTCAGCCCACCCATG    3720
1198    L   T   G   I   H   A   V   E   E   V   S   L   E   E   F   S   A   H   P   C    1217

3721  TGCCCGTGACAATGGTGGCTGCTCCCACATCTGTATTGCCAAGGGTGATGGACACCACG    3780
1218    A   R   D   N   G   G   C   S   H   I   C   I   A   K   G   D   G   T   P   R    1237

3781  GTGCTCATGCCCAGTCCACCTCGTCCTCTGCAGAACCTGCTGACCTGTGGAGAGCCCGCC    3840
1238    C   S   C   P   V   H   L   V   L   L   Q   N   L   L   T   C   G   E   P   P    1257
```

FIG. 6H

```
3841 CACCTGTGCTCCCCGGACCAGTTTGCATGTGCCACAGGGGAGATCGACTGTATCCCCGGGGC 3900
1258   T  C  S  P  D  Q  F  A  C  A  T  G  E  I  D  C  I  P  G  A  1277

3901 CTGGCGCTGTGACGGCTTTCCCGAGTGCGATGACCAGAGCGACGAGGAGGGCTGCCCCGT 3960
1278   W  R  C  D  G  F  P  E  C  D  D  Q  S  D  E  E  G  C  P  V  1297

3961 GTGCTCCGCGCCCAGTTCCCCTGCGCGCGGGGTCAGTGTGTGGACCTGTGCCGCTGCGCTG 4020
1298   C  S  A  A  Q  F  P  C  A  R  G  Q  C  V  D  L  R  L  R  C  1317

4021 CGACGGCGAGGCAGACTGTCAGGACCGCTCAGACGAGGTGGACTGTGACGCCATCTGCCT 4080
1318   D  G  E  A  D  C  Q  D  R  S  D  E  V  D  C  D  A  I  C  L  1337

4081 GCCCAACCAGTTCCGGTGTGCGAGCGGCCAGTGTGTCCTCATCAAACAGCAGTGCGACTC 4140
1338   P  N  Q  F  R  C  A  S  G  Q  C  V  L  I  K  Q  Q  C  D  S  1357

4141 CTTCCCCGACTGTATCGACGGTCCGACGAGCTCATGTGTGAAATCACCAAGCCGCCCTC 4200
1358   F  P  D  C  I  D  G  S  D  E  L  M  C  E  I  T  K  P  P  S  1377

4201 AGACGACAGCCCGGCCCACAGCAGTGCCATCGGGCCCGTCATTGGCATCATCCTCTCTCT 4260
1378   D  D  S  P  A  H  S  S  A  I  G  P  V  I  G  I  I  L  S  L  1397

4261 CTTCGTCATGGGTGGTGTCTATTTTGTGTGCCAGCGTGTGTGCCAGCGCTATGCGGG 4320
1398   F  V  M  G  G  V  Y  F  V  C  Q  R  V  C  Q  R  Y  A  G  1417

4321 GGCCAACGGGCCCTTCCCGCACGAGTATGTCAGCGGGACCCCGCACGTGCCCCTCAATTT 4380
1418   A  N  G  P  F  P  H  E  Y  V  S  G  T  P  H  V  P  L  N  F  1437
```

FIG. 61

```
4381  CATAGCCCCGGGGGGTTCCCAGCATGGCCCCTTCACAGGCATCGCATGCGGAAAGTCCAT  4440
1438   I  A  P  G  G  G  V  P  Q  H  G  P  F  T  G  I  A  C  G  K  S  M   1457

4441  GATGAGCTCCGTGAGCCTGATGGGGGGCCGGGGTGCCCCTCTACGACCGGAACCA       4500
1458   M  S  S  V  S  L  M  G  G  R  G  G  V  P  L  Y  D  R  N  H        1477

4501  CGTCACAGGGCCTCGTCCAGCAGTCTCCAGCACGAAGGCCACGCTGTACCCGCCGAT     4560
1478   V  T  G  A  S  S  S  S  T  K  A  T  L  Y  P  P  I              1497

4561  CCTGAACCCGCCCGCCCCCTCCCCGGCCACGGACCCCTCCCTGTACAACATGGACATGTTCTA  4620
1498   L  N  P  P  P  P  S  P  A  T  D  P  S  L  Y  N  M  D  M  F  Y     1517

4621  CTCTTCAAACATTCCGGCCACTGCGAGACCGTACAGGCCCTACATCATTCGAGGAATGGC  4680
1518   S  S  N  I  P  A  T  A  R  P  Y  R  R  P  Y  I  I  R  G  M  A     1537

4681  GCCCCGACGACGCCCCTGCGAGCACCGACGTGTGTGACAGCGACTACAGCGCCAGCCGCTG  4740
1538   P  P  T  T  P  C  S  T  D  V  C  D  S  D  Y  S  A  S  R  W        1557

4741  GAAGGCCAGCAAGTACTACCTGGATTTGAACTCGGACTCAGACCCCTATCCCACCCACC    4800
1558   K  A  S  K  Y  Y  L  D  L  N  S  D  S  D  P  Y  P  P  P  P        1577

4801  CACGCCCCACAGCCAGTACCTGTCGGCGGAGGACAGCTGCCCGCCTCGCCCGCCACCGA    4860
1578   T  P  H  S  Q  Y  L  S  A  E  D  S  C  P  P  S  P  A  T  E        1597

4861  GAGGAGCTACTTCCATCTCTTCCCGCCTCCCCGTCCCCTGCACGGACTCATCCTGACC     4920
1598   R  S  Y  F  H  L  F  P  P  P  P  P  S  P  C  T  D  S  S          1615
```

FIG. 6J

```
4921  TCGGCCGGGCCACTCTCTGGCTTCTCTGTGCCCCTGTAAATAGTTTTAAATATGAACAAAGA
4981  AAAAATATATTTATGATTTAAAAATATAATTGGGATTTAAAACATGAGAAA              4980
5041  TGTGAACTGTGATGGGCTGGGCAGGCTGGGAGAACTTTGTACAGTGGAGAAATATTTAT    5040
5101  AAACTTAATTTTGTAAAACA  5120                                      5100
```

Mouse Zmax1 In situ hybridization
100X Magnification

Antisense probe

Mouse Zmax1 In situ hybridization
100X Magnification

Sense probe

Mouse Zmax1 In situ hybridization
400X Magnification
Antisense probe

Osteoblasts ——→                                    Endosteum

Mouse Zmax1 In situ hybridization
400X Magnification
Sense probe

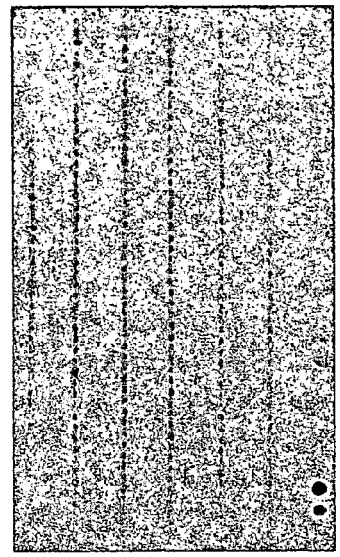
FIG. 14B
Zmax1 Exon3 ASO Assay
T-specific Oligo
58 °C Wash
   
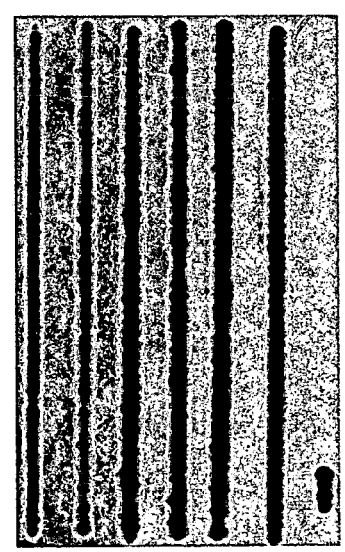
FIG. 14A
Zmax1 Exon3 ASO Assay
G-specific Oligo
55 °C Wash
   

HBM: Constructs for transgenic mice
*Confirmation of expression*
*Transient transfection into HOB-02-02 cells\**

| CMV βActin | | Type I collagen | |
|---|---|---|---|
| HBM | Zmax1 | HBM | Zmax1 |
| X 1,000 | X 1,000 | X 10 | X 10 |

*\*Fold increase compared to Zmax1
in cells transfected with empty vector*

FIG. 17

HBM: Transgenic mice
mRNA expression by Taqman analysis*

| | Tissue | | | | | | |
|---|---|---|---|---|---|---|---|
| Line | Tibia | Femur | Heart | Gonad | Brain | Kidney | Liver |
| HBMMCBA | | | | | | | |
| 2 | 7-10 | | 20-90 | 2-30 | 6-11 | 5-9 | <1 |
| 13 | 1-2 | | 6-7 | 3-4 | 5-6 | <1 | <1 |
| 18 | 10-11 | | | | | | |
| HBMMTIC | | | | | | | |
| 19 | 7-8 | 19-20 | 1 | | | | 1 |
| 35 | 1 | 1 | 0 | | | | 0 |

* relative to Zmax1 in HOB-03-C5

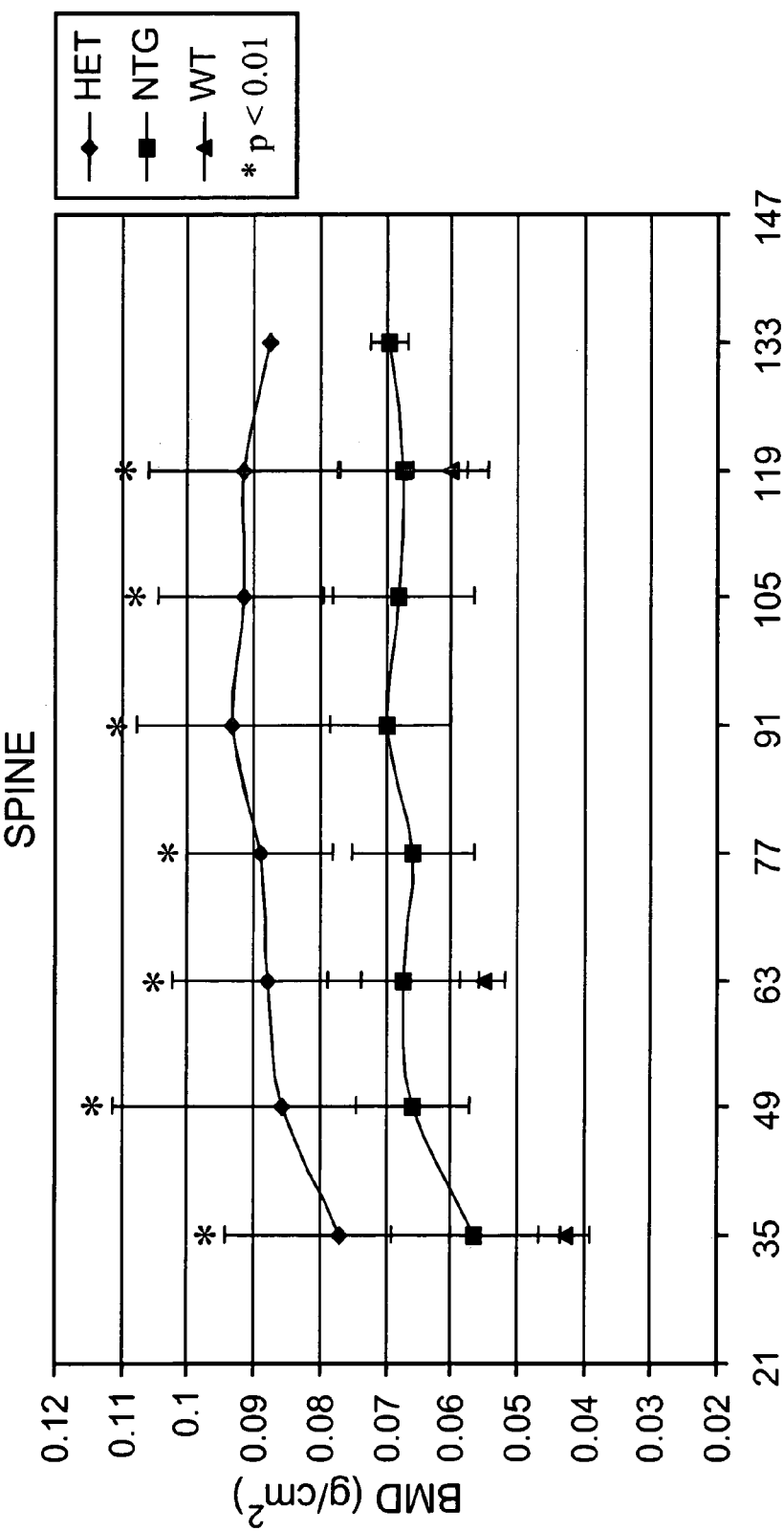

HBM transgenic mice: in vivo pDXA*
*BMD % changes vs WT in 5 week old animals*

| Line | n | Femur | Spine | Total | Tibia mRNA |
|---|---|---|---|---|---|
| HBMMCBA | | | | | |
| 2 | 11 | 21 | 24 | 10 | x7-10 |
| 13 | 4 | 11 | 27 | 5 | x1-2 |
| 18 | 1 | 8 | 9 | 3 | x10-11 |
| 21 | 1 | 10 | 12 | 6 | 0 |
| 28 | 15 | 0 | 30 | 4 | x1 |
| 30 | 7 | 4 | 32 | 4 | 0 |
| HBMMTIC | | | | | |
| 19 | 5 | 63 | 70 | 41 | x7-8 |
| 35 | 1 | 4 | 47 | 6 | x1 |

* CV: Femur (2.7%); Spine (6.4%); Total (1.7%)

FIG. 22

HBM transgenic mice: in vivo pDXA*
*BMD % changes vs WT in 9 week old animals*

| Line | n | Femur | Spine | Total |
|---|---|---|---|---|
| HBMMCBA | | | | |
| 2 | 3 | 19 | 32 | 12 |
| HBMMTIC | | | | |
| 19 | 2 | 52 | 64 | 37 |
| 35 | 3 | 32 | 43 | 18 |

* CV: Femur (2.7%); Spine (6.4%); Total (1.7%)

HBMGI_2AS

```
TCTAGACTCG AGGCGGCCGC CCATTGTGCA CTAAAGCGCC GCCGCCGCGC CATGGAGCCC
GAGTGAGCGC GGCGCGGGCC CGTCCGGCCG CCGGACAACA TGGAGGCAGC GCCGCCCGGG
CCGCCGTGGC CGCTGCTGCT GCTGCTGCTG CTGCTGCTGG CGCTGTGCGG CTGCCCGGCC
CCCGCCGCGG CCTCGCCGCT CCTGCTATTT GCCAACCGCC GGGACGTACG GCTGGTGGAC
GCCGGCGGAG TCAAGCTGGA GTCCACCATC GTGGTCAGCG GCCTGGAGGA TGCGGCCGCA
GTGGACTTCC AGTTTTCCAA GGGAGCCGTG TACTGGACAG ACGTGAGCGA GGAGGCCATC
AAGCAGACCT ACCTGAACCA GACGGGGGCC GCCGTGCAGA ACGTGGTCAT CTCCGGCCTG
GTCTCTCCCG ACGGCCTCGC CTGCGACTGG GTGGGCAAGA AGCTGTACTG GACGGACTCA
GAGACCAACC GCATCGAGGT GGCCAACCTC AATGGCACAT CCCGGAAGGT GCTCTTCTGG
CAGGACCTTG ACCAGCCGAG GGCCATCGCC TTGGACCCCG CTCACGGGTA CATGTACTGG
ACAGACTGGG TTGAGACGCC CCGGATTGAG CGGGCAGGGA TGGATGGCAG CACCCGGAAG
ATCATTGTGG ACTCGGACAT TTACTGGCCC AATGGACTGA CCATCGACCT GGAGGAGCAG
AAGCTCTACT GGGCTGACGC CAAGCTCAGC TTCATCCACC GTGCCAACCT GGACGGCTCG
TTCCGGCAGA AGGTGGTGGA GGGCAGCCTG ACGCACCCCT TCGCCCTGAC GCTCTCCGGG
GACACTCTGT ACTGGACAGA CTGGCAGACC CGCTCCATCC ATGCCTGCAA CAAGCGCACT
GGGGGGAAGA GGAAGGAGAT CCTGAGTGCC CTCTACTCAC CCATGGACAT CCAGGTGCTG
AGCCAGGAGC GGCAGCCTTT CTTCCACACT CGCTGTGAGG AGGACAATGG CGGCTGCTCC
CACCTGTGCC TGCTGTCCCC AAGCGAGCCT TTCTACACAT GCGCCTGCCC CACGGGTGTG
CAGCTGCAGG ACAACGGCAG GACGTGTAAG GCAGGAGCCG AGGAGGTGCT GCTGCTGGCC
CGGCGGACGG ACCTACGGAG GATCTCGCTG GACACGCCGG ACTTCACCGA CATCGTGCTG
CAGGTGGACG ACATCCGGCA CGCCATTGCC ATCGACTACG ACCCGCTAGA GGGCTATGTC
TACTGGACAG ATGACGAGGT GCGGGCCATC CGCAGGGCGT ACCTGGACGG GTCTGGGGCG
CAGACGCTGG TCAACACCGA GATCAACGAC CCCGATGGCA TCGCGGTCGA CTGGGTGGCC
CGAAACCTCT ACTGGACCGA CACGGGCACG GACCGCATCG AGGTGACGCG CCTCAACGGC
```

FIG. 24B

HBMGl_2AS

```
ACCTCCCGCA AGATCCTGGT GTCGGAGGAC CTGGACGAGC CCCGAGCCAT CGCACTGCAC
CCCGTGATGG GCCTCATGTA CTGGACAGAC TGGGGAGAGA ACCCTAAAAT CGAGTGTGCC
AACTTGGATG GGCAGGAGCG GCGTGTGCTG GTCAATGCCT CCCTCGGGTG GCCCAACGGC
CTGGCCCTGG ACCTGCAGGA GGGGAAGCTC TACTGGGGAG ACGCCAAGAC AGACAAGATC
GAGGTGATCA ATGTTGATGG GACGAAGAGG CGGACCCTCC TGGAGGACAA GCTCCCGCAC
ATTTTCGGGT TCACGCTGCT GGGGGACTTC ATCTACTGGA CTGACTGGCA GCGCCGCAGC
ATCGAGCGGG TGCACAAGGT CAAGGCCAGC CGGGACGTCA TCATTGACCA GCTGCCCGAC
CTGATGGGGC TCAAAGCTGT GAATGTGGCC AAGGTCGTCG GAACCAACCC GTGTGCGGAC
AGGAACGGGG GGTGCAGCCA CCTGTGCTTC TTCACACCCC ACGCAACCCG GTGTGGCTGC
CCCATCGGCC TGGAGCTGCT GAGTGACATG AAGACCTGCA TCGTGCCTGA GGCCTTCTTG
GTCTTCACCA GCAGAGCCGC CATCCACAGG ATCTCCCTCG AGACCAATAA CAACGACGTG
GCCATCCCGC TCACGGGCGT CAAGGAGGCC TCAGCCCTGG ACTTTGATGT GTCCAACAAC
CACATCTACT GGACAGACGT CAGCCTGAAG ACCATCAGCC GCGCCTTCAT GAACGGGAGC
TCGGTGGAGC ACGTGGTGGA GTTTGGCCTT GACTACCCCG AGGGCATGGC CGTTGACTGG
ATGGGCAAGA ACCTCTACTG GGCCGACACT GGGACCAACA GAATCGAAGT GGCGCGGCTG
GACGGGCAGT TCCGGCAAGT CCTCGTGTGG AGGGACTTGG ACAACCCGAG GTCGCTGGCC
CTGGATCCCA CCAAGGGCTA CATCTACTGG ACCGAGTGGG GCGGCAAGCC GAGGATCGTG
CGGGCCTTCA TGGACGGGAC CAACTGCATG ACGCTGGTGG ACAAGGTGGG CCGGGCCAAC
GACCTCACCA TTGACTACGC TGACCAGCGC CTCTACTGGA CCGACCTGGA CACCAACATG
ATCGAGTCGT CCAACATGCT GGGTCAGGAG CGGGTCGTGA TTGCCGACGA TCTCCCGCAC
CCGTTCGGTC TGACGCAGTA CAGCGATTAT ATCTACTGGA CAGACTGGAA TCTGCACAGC
ATTGAGCGGG CCGACAAGAC TAGCGGCCGG AACCGCACCC TCATCCAGGG CCACCTGGAC
TTCGTGATGG ACATCCTGGT GTTCCACTCC TCCCGCCAGG ATGGCCTCAA TGACTGTATG
```

FIG. 24C

HBMGI_2AS

```
CACAACAACG GGCAGTGTGG GCAGCTGTGC CTTGCCATCC CCGGCGGCCA CCGCTGCGGC
TGCGCCTCAC ACTACACCCT GGACCCCAGC AGCCGCAACT GCAGCCCGCC CACCACCTTC
TTGCTGTTCA GCCAGAAATC TGCCATCAGT CGGATGATCC CGGACGACCA GCACAGCCCG
GATCTCATCC TGCCCCTGCA TGGACTGAGG AACGTCAAAG CCATCGACTA TGACCCACTG
GACAAGTTCA TCTACTGGGT GGATGGGCGC CAGAACATCA AGCGAGCCAA GGACGACGGG
ACCCAGCCCT TTGTTTTGAC CTCTCTGAGC CAAGGCCAAA ACCCAGACAG GCAGCCCCAC
GACCTCAGCA TCGACATCTA CAGCCGGACA CTGTTCTGGA CGTGCGAGGC CACCAATACC
ATCAACGTCC ACAGGCTGAG CGGGGAAGCC ATGGGGGTGG TGCTGCGTGG GGACCGCGAC
AAGCCCAGGG CCATCGTCGT CAACGCGGAG CGAGGGTACC TGTACTTCAC CAACATGCAG
GACCGGGCAG CCAAGATCGA ACGCGCAGCC CTGGACGGCA CCGAGCGCGA GGTCCTCTTC
ACCACCGGCC TCATCCGCCC TGTGGCCCTG GTGGTAGACA ACACACTGGG CAAGCTGTTC
TGGGTGGACG CGGACCTGAA GCGCATTGAG AGCTGTGACC TGTCAGGGGC CAACCGCCTG
ACCCTGGAGG ACGCCAACAT CGTGCAGCCT CTGGGCCTGA CCATCCTTGG CAAGCATCTC
TACTGGATCG ACCGCCAGCA GCAGATGATC GAGCGTGTGG AGAAGACCAC CGGGGACAAG
CGGACTCGCA TCCAGGGCCG TGTCGCCCAC CTCACTGGCA TCCATGCAGT GGAGGAAGTC
AGCCTGGAGG AGTTCTCAGC CCACCCATGT GCCCGTGACA ATGGTGGCTG CTCCCACATC
TGTATTGCCA AGGGTGATGG GACACCACGG TGCTCATGCC CAGTCCACCT CGTGCTCCTG
CAGAACCTGC TGACCTGTGG AGAGCCGCCC ACCTGCTCCC CGGACCAGTT TGCATGTGCC
ACAGGGGAGA TCGACTGTAT CCCCGGGGCC TGGCGCTGTG ACGGCTTTCC CGAGTGCGAT
GACCAGAGCG ACGAGGAGGG CTGCCCCGTG TGCTCCGCCG CCCAGTTCCC CTGCGCGCGG
GGTCAGTGTG TGGACCTGCG CCTGCGCTGC GACGGCGAGG CAGACTGTCA GGACCGCTCA
GACGAGGCGG ACTGTGACGC CATCTGCCTG CCCAACCAGT TCCGGTGTGC GAGCGGCCAG
TGTGTCCTCA TCAAACAGCA GTGCGACTCC TTCCCCGACT GTATCGACGG CTCCGACGAG
CTCATGTGTG AAATCACCAA GCCGCCCTCA GACGACAGCC CGGCCCACAG CAGTGCCATC
```

FIG. 24D

HBMGI_2AS

```
GGGCCCGTCA TTGGCATCAT CCTCTCTCTC TTCGTCATGG GTGGTGTCTA TTTTGTGTGC
CAGCGCGTGG TGTGCCAGCG CTATGCGGGG GCCAACGGGC CCTTCCCGCA CGAGTATGTC
AGCGGGACCC CGCACGTGCC CCTCAATTTC ATAGCCCCGG GCGGTTCCCA GCATGGCCCC
TTCACAGGCA TCGCATGCGG AAAGTCCATG ATGAGCTCCG TGAGCCTGAT GGGGGGCCGG
GGCGGGGTGC CCCTCTACGA CCGGAACCAC GTCACAGGGG CCTCGTCCAG CAGCTCGTCC
AGCACGAAGG CCACGCTGTA CCCGCCGATC CTGAACCCGC CGCCCTCCCC GGCCACGGAC
CCCTCCCTGT ACAACATGGA CATGTTCTAC TCTTCAAACA TTCCGGCCAC TGCGAGACCG
TACAGGCCCT ACATCATTCG AGGAATGGCG CCCCCGACGA CGCCCTGCAG CACCGACGTG
TGTGACAGCG ACTACAGCGC CAGCCGCTGG AAGGCCAGCA AGTACTACCT GGATTTGAAC
TCGGACTCAG ACCCCTATCC ACCCCCACCC ACGCCCCACA GCCAGTACCT GTCGGCGGAG
GACAGCTGCC CGCCCTCGCC CGCCACCGAG AGGAGCTACT TCCATCTCTT CCCGCCCCCT
CCGTCCCCCT GCACGGACTC ATCCTGACCT CGGCCGGGCC ACTCTGGCTT CTCTGTGCCC
CTGTAAATAG TTTTAAATAT GAACAAAGAA AAAAATATAT TTTATGATTT AAAAAATAAA
TATAATTGGG ATTTTAAAAA CATGAGAAAT GTGAACTGTG ATGGGGTGGG CAGGGCTGGG
AGAACTTTGT ACAGTGGAGA AATATTTATA AACTTAATTT TGTAAAACAG AAAAAAAAAA
AAAAAAAAAA AAAAAAAAAA AAAAAAAAAA AAAAAAAAAA AAAAAAAAAA AAAAAAAAAA
AAAAAAAAAA AAAAAAAAAA AAAAAAAAAA AAAAAAAAAA AAAAAAAAAA GCGGCCGC
```

FIG. 25A

ZMAXGI_3AS

```
TCTAGACTCG AGGCGGCCGC CCATTGTGCA CTAAAGCGCC GCCGCCGCGC CATGGAGCCC
GAGTGAGCGC GGCGCGGGCC CGTCCGGCCG CCGGACAACA TGGAGGCAGC GCCGCCCGGG
CCGCCGTGGC CGCTGCTGCT GCTGCTGCTG CTGCTGCTGG CGCTGTGCGG CTGCCCGGCC
CCCGCCGCGG CCTCGCCGCT CCTGCTATTT GCCAACCGCC GGGACGTACG GCTGGTGGAC
GCCGGCGGAG TCAAGCTGGA GTCCACCATC GTGGTCAGCG GCCTGGAGGA TGCGGCCGCA
GTGGACTTCC AGTTTTCCAA GGGAGCCGTG TACTGGACAG ACGTGAGCGA GGAGGCCATC
AAGCAGACCT ACCTGAACCA GACGGGGGCC GCCGTGCAGA ACGTGGTCAT CTCCGGCCTG
GTCTCTCCCG ACGGCCTCGC CTGCGACTGG GTGGGCAAGA AGCTGTACTG GACGGACTCA
GAGACCAACC GCATCGAGGT GGCCAACCTC AATGGCACAT CCCGGAAGGT GCTCTTCTGG
CAGGACCTTG ACCAGCCGAG GGCCATCGCC TTGGACCCCG CTCACGGGTA CATGTACTGG
ACAGACTGGG GTGAGACGCC CCGGATTGAG CGGGCAGGGA TGGATGGCAG CACCCGGAAG
ATCATTGTGG ACTCGGACAT TTACTGGCCC AATGGACTGA CCATCGACCT GGAGGAGCAG
AAGCTCTACT GGGCTGACGC CAAGCTCAGC TTCATCCACC GTGCCAACCT GGACGGCTCG
TTCCGGCAGA AGGTGGTGGA GGGCAGCCTG ACGCACCCCT TCGCCCTGAC GCTCTCCGGG
GACACTCTGT ACTGGACAGA CTGGCAGACC CGCTCCATCC ATGCCTGCAA CAAGCGCACT
GGGGGGAAGA GGAAGGAGAT CCTGAGTGCC CTCTACTCAC CCATGGACAT CCAGGTGCTG
AGCCAGGAGC GGCAGCCTTT CTTCCACACT CGCTGTGAGG AGGACAATGG CGGCTGCTCC
CACCTGTGCC TGCTGTCCCC AAGCGAGCCT TTCTACACAT GCGCCTGCCC CACGGGTGTG
CAGCTGCAGG ACAACGGCAG GACGTGTAAG GCAGGAGCCG AGGAGGTGCT GCTGCTGGCC
CGGCGGACGG ACCTACGGAG GATCTCGCTG GACACGCCGG ACTTCACCGA CATCGTGCTG
CAGGTGGACG ACATCCGGCA CGCCATTGCC ATCGACTACG ACCCGCTAGA GGGCTATGTC
TACTGGACAG ATGACGAGGT GCGGGCCATC CGCAGGGCGT ACCTGGACGG GTCTGGGGCG
CAGACGCTGG TCAACACCGA GATCAACGAC CCCGATGGCA TCGCGGTCGA CTGGGTGGCC
CGAAACCTCT ACTGGACCGA CACGGGCACG GACCGCATCG AGGTGACGCG CCTCAACGGC
```

FIG. 25B

ZMAXGI_3AS

```
ACCTCCCGCA AGATCCTGGT GTCGGAGGAC CTGGACGAGC CCCGAGCCAT CGCACTGCAC
CCCGTGATGG GCCTCATGTA CTGGACAGAC TGGGGAGAGA ACCCTAAAAT CGAGTGTGCC
AACTTGGATG GGCAGGAGCG GCGTGTGCTG GTCAATGCCT CCCTCGGGTG GCCCAACGGC
CTGGCCCTGG ACCTGCAGGA GGGGAAGCTC TACTGGGGAG ACGCCAAGAC AGACAAGATC
GAGGTGATCA ATGTTGATGG GACGAAGAGG CGGACCCTCC TGGAGGACAA GCTCCCGCAC
ATTTTCGGGT TCACGCTGCT GGGGGACTTC ATCTACTGGA CTGACTGGCA GCGCCGCAGC
ATCGAGCGGG TGCACAAGGT CAAGGCCAGC CGGGACGTCA TCATTGACCA GCTGCCCGAC
CTGATGGGGC TCAAAGCTGT GAATGTGGCC AAGGTCGTCG AACCAACCC GTGTGCGGAC
AGGAACGGGG GGTGCAGCCA CCTGTGCTTC TTCACACCCC ACGCAACCCG GTGTGGCTGC
CCCATCGGCC TGGAGCTGCT GAGTGACATG AAGACCTGCA TCGTGCCTGA GGCCTTCTTG
GTCTTCACCA GCAGAGCCGC CATCCACAGG ATCTCCCTCG AGACCAATAA CAACGACGTG
GCCATCCCGC TCACGGGCGT CAAGGAGGCC TCAGCCCTGG ACTTTGATGT GTCCAACAAC
CACATCTACT GGACAGACGT CAGCCTGAAG ACCATCAGCC GCGCCTTCAT GAACGGGAGC
TCGGTGGAGC ACGTGGTGGA GTTTGGCCTT GACTACCCCG AGGGCATGGC CGTTGACTGG
ATGGGCAAGA ACCTCTACTG GGCCGACACT GGGACCAACA GAATCGAAGT GGCGCGGCTG
GACGGGCAGT CCGGCAAGT CCTCGTGTGG AGGGACTTGG ACAACCCGAG GTCGCTGGCC
CTGGATCCCA CCAAGGGCTA CATCTACTGG ACCGAGTGGG GCGGCAAGCC GAGGATCGTG
CGGGCCTTCA TGGACGGGAC CAACTGCATG ACGCTGGTGG ACAAGGTGGG CCGGGCCAAC
GACCTCACCA TTGACTACGC TGACCAGCGC CTCTACTGGA CCGACCTGGA CACCAACATG
ATCGAGTCGT CCAACATGCT GGGTCAGGAG CGGGTCGTGA TTGCCGACGA TCTCCCGCAC
CCGTTCGGTC TGACGCAGTA CAGCGATTAT ATCTACTGGA CAGACTGGAA TCTGCACAGC
ATTGAGCGGG CCGACAAGAC TAGCGGCCGG AACCGCACCC TCATCCAGGG CCACCTGGAC
TTCGTGATGG ACATCCTGGT GTTCCACTCC TCCCGCCAGG ATGGCCTCAA TGACTGTATG
```

FIG. 25C

ZMAXGI_3AS

```
CACAACAACG GGCAGTGTGG GCAGCTGTGC CTTGCCATCC CCGGCGGCCA CCGCTGCGGC
TGCGCCTCAC ACTACACCCT GGACCCCAGC AGCCGCAACT GCAGCCCGCC CACCACCTTC
TTGCTGTTCA GCCAGAAATC TGCCATCAGT CGGATGATCC CGGACGACCA GCACAGCCCG
GATCTCATCC TGCCCCTGCA TGGACTGAGG AACGTCAAAG CCATCGACTA TGACCCACTG
GACAAGTTCA TCTACTGGGT GGATGGGCGC CAGAACATCA AGCGAGCCAA GGACGACGGG
ACCCAGCCCT TTGTTTTGAC CTCTCTGAGC CAAGGCCAAA ACCCAGACAG GCAGCCCCAC
GACCTCAGCA TCGACATCTA CAGCCGGACA CTGTTCTGGA CGTGCGAGGC CACCAATACC
ATCAACGTCC ACAGGCTGAG CGGGGAAGCC ATGGGGGTGG TGCTGCGTGG GGACCGCGAC
AAGCCCAGGG CCATCGTCGT CAACGCGGAG CGAGGGTACC TGTACTTCAC CAACATGCAG
GACCGGGCAG CCAAGATCGA ACGCGCAGCC CTGGACGGCA CCGAGCGCGA GGTCCTCTTC
ACCACCGGCC TCATCCGCCC TGTGGCCCTG GTGGTAGACA ACACACTGGG CAAGCTGTTC
TGGGTGGACG CGGACCTGAA GCGCATTGAG AGCTGTGACC TGTCAGGGGC CAACCGCCTG
ACCCTGGAGG ACGCCAACAT CGTGCAGCCT CTGGGCCTGA CCATCCTTGG CAAGCATCTC
TACTGGATCG ACCGCCAGCA GCAGATGATC GAGCGTGTGG AGAAGACCAC CGGGGACAAG
CGGACTCGCA TCCAGGGCCG TGTCGCCCAC CTCACTGGCA TCCATGCAGT GGAGGAAGTC
AGCCTGGAGG AGTTCTCAGC CCACCCATGT GCCCGTGACA ATGGTGGCTG CTCCCACATC
TGTATTGCCA AGGGTGATGG GACACCACGG TGCTCATGCC CAGTCCACCT CGTGCTCCTG
CAGAACCTGC TGACCTGTGG AGAGCCGCCC ACCTGCTCCC CGGACCAGTT TGCATGTGCC
ACAGGGGAGA TCGACTGTAT CCCCGGGGCC TGGCGCTGTG ACGGCTTTCC CGAGTGCGAT
GACCAGAGCG ACGAGGAGGG CTGCCCCGTG TGCTCCGCCG CCAGTTCCCC TGCGCGCGG
GGTCAGTGTGT GGACCTGCGC CTGCGCTGCG ACGGCGAGGC AGACTGTCAG GACCGCTCA
GACGAGGCGGA CTGTGACGCC ATCTGCCTGC CAACCAGTT CCGGTGTGCG AGCGGCCAG
TGTGTCCTCAT CAAACAGCAG TGCGACTCCT TCCCCGACTG TATCGACGGC TCCGACGAG
CTCATGTGTGA AATCACCAAG CCGCCCTCAG ACGACAGCCC GGCCCACAGC AGTGCCATC
```

FIG. 25D

ZMAXGI_3AS

```
GGGCCCGTCA TTGGCATCAT CCTCTCTCTC TTCGTCATGG GTGGTGTCTA TTTTGTGTGC
CAGCGCGTGG TGTGCCAGCG CTATGCGGGG GCCAACGGGC CCTTCCCGCA CGAGTATGTC
AGCGGGACCC CGCACGTGCC CCTCAATTTC ATAGCCCCGG GCGGTTCCCA GCATGGCCCC
TTCACAGGCA TCGCATGCGG AAAGTCCATG ATGAGCTCCG TGAGCCTGAT GGGGGGCCGG
GGCGGGGTGC CCCTCTACGA CCGGAACCAC GTCACAGGGG CCTCGTCCAG CAGCTCGTCC
AGCACGAAGG CCACGCTGTA CCCGCCGATC CTGAACCCGC CGCCCTCCCC GGCCACGGAC
CCCTCCCTGT ACAACATGGA CATGTTCTAC TCTTCAAACA TTCCGGCCAC TGCGAGACCG
TACAGGCCCT ACATCATTCG AGGAATGGCG CCCCGACGA CGCCCTGCAG CACCGACGTG
TGTGACAGCG ACTACAGCGC CAGCCGCTGG AAGGCCAGCA AGTACTACCT GGATTTGAAC
TCGGACTCAG ACCCCTATCC ACCCCCACCC ACGCCCCACA GCCAGTACCT GTCGGCGGAG
GACAGCTGCC CGCCCTCGCC CGCCACCGAG AGGAGCTACT TCCATCTCTT CCCGCCCCCT
CCGTCCCCCT GCACGGACTC ATCCTGACCT CGGCCGGGCC ACTCTGGCTT CTCTGTGCCC
CTGTAAATAG TTTTAAATAT GAACAAAGAA AAAAATATAT TTTATGATTT AAAAAATAAA
TATAATTGGG ATTTTAAAAA CATGAGAAAT GTGAACTGTG ATGGGGTGGG CAGGGCTGGG
AGAACTTTGT ACAGTGGAGA AATATTTATA AACTTAATTT TGTAAAACAG AAAAAAAAAA
AAAAAAAAAA AAAAAAAAAA AAAAAAAAAA AAAAAAAAAA AAAAAAAAAA AAAAAAAAAA
AAAAAAAAAA AAAAAAAAAA AAAAAAAAAA AAAAAAAAAA AAAAAAAAAA GCGGCCGC
```

FIG. 26A
Alignment of Human and Mouse Zmax1 (LRP5) Amino-Acid Sequences.
Top = Human, Bottom = Mouse

```
  1 MEA....APPGPPWPLLLLLLLLLALCGCPAPAAASPLLLFANRRDVRLV  46
    ||.    |||.|| ||||:     |::. .|||||||||||||||||||
  1 METAPTRAPPPPPPPLLLLV.....LYCSLVPAAASPLLLFANRRDVRLV  45

47 DAGGVKLESTIVVSGLEDAAAVDFQFSKGAVYWTDVSEEAIKQTYLNQTG  96
    |||||||||||||.|||||||||||||||||||||||||||||||||||
 46 DAGGVKLESTIVASGLEDAAAVDFQFSKGAVYWTDVSEEAIKQTYLNQTG  95

97 AAVQNVVISGLVSPDGLACDWVGKKLYWTDSETNRIEVANLNGTSRKVLF 146
    ||.||:|||||||||||||||||||||||||||||||||||||||||||
 96 AAAQNIVISGLVSPDGLACDWVGKKLYWTDSETNRIEVANLNGTSRKVLF 145

147 WQDLDQPRAIALDPAHGYMYWTDWGETPRIERAGMDGSTRKIIVDSDIYW 196
    |||||||||||||||||||||||||.|||||||||||||||||||||||
146 WQDLDQPRAIALDPAHGYMYWTDWGEAPRIERAGMDGSTRKIIVDSDIYW 195

197 PNGLTIDLEEQKLYWADAKLSFIHRANLDGSFRQKVVEGSLTHPFALTLS 246
    |||||||||||||||||||||||||||||||||||||||||||||||||
196 PNGLTIDLEEQKLYWADAKLSFIHRANLDGSFRQKVVEGSLTHPFALTLS 245

247 GDTLYWTDWQTRSIHACNKRTGGKRKEILSALYSPMDIQVLSQERQPFFH 296
    |||||||||||||||||||:||:.|||||||||||||||||||||||||
246 GDTLYWTDWQTRSIHACNKWTGEQRKEILSALYSPMDIQVLSQERQPPFH 295

297 TRCEEDNGGCSHLCLLSPSEPFYTCACPTGVQLQDNGRTCKAGAEEVLLL 346
    |.||||||||||||||.||||.|.|||||||||||||:|||.||||||| 
296 TPCEEDNGGCSHLCLLSPREPFYSCACPTGVQLQDNGKTCKTGAEEVLLL 345

347 ARRTDLRRISLDTPDFTDIVLQVDDIRHAIAIDYDPLEGYVYWTDDEVRA 396
    |||||||||||||||||||||||:|||||||||||||||||||||||||
346 ARRTDLRRISLDTPDFTDIVLQVGDIRHAIAIDYDPLEGYVYWTDDEVRA 395

397 IRRAYLDGSGAQTLVNTEINDPDGIAVDWVARNLYWTDTGTDRIEVTRLN 446
    |||||||||||||||||||||||||||||||||||||||||||||||||
396 IRRAYLDGSGAQTLVNTEINDPDGIAVDWVARNLYWTDTGTDRIEVTRLN 445

447 GTSRKILVSEDLDEPRAIALHPVMGLMYWTDWGENPKIECANLDGQERRV 496
    |||||||||||||||||.||||||||||||||||||||||||||.:|.| 
446 GTSRKILVSEDLDEPRAIVLHPVMGLMYWTDWGENPKIECANLDGRDRHV 495

497 LVNASLGWPNGLALDLQEGKLYWGDAKTDKIEVINVDGTKRRTLLEDKLP 546
    |||.|||||||||||||||||||||||||||||:|||||:|||||||||
496 LVNTSLGWPNGLALDLQEGKLYWGDAKTDKIEVINIDGTKRKTLLEDKLP 545

547 HIFGFTLLGDFIYWTDWQRRSIERVHKVKASRDVIIDQLPDLMGLKAVNV 596
    |||||||||||||||||||||||||||||||||||||||||||||||||
546 HIFGFTLLGDFIYWTDWQRRSIERVHKVKASRDVIIDQLPDLMGLKAVNV 595

597 AKVVGTNPCADRNGGCSHLCFFTPHATRCGCPIGLELLSDMKTCIVPEAF 646
    |||||||||||:||||||||||||||.||||||||||||||||||:|||
596 AKVVGTNPCADGNGGCSHLCFFTPRATKCGCPIGLELLSDMKTCIIPEAF 645

647 LVFTSRAAIHRISLETNNNDVAIPLTGVKEASALDFDVSNNHIYWTDVSL 696
    |||||||.||||||||||||||||||||||||||||||||||||||||| 
646 LVFTSRATIHRISLETNNNDVAIPLTGVKEASALDFDVSNNHIYWTDVSL 695
```

FIG. 26B
Alignment of Human and Mouse Zmax1 (LRP5) Amino-Acid Sequences.

```
 697 KTISRAFMNGSSVEHVVEFGLDYPEGMAVDWMGKNLYWADTGTNRIEVAR  746
     |||||||||||||||:|||||||||||||||||||||||||||||||||
 696 KTISRAFMNGSSVEHVIEFGLDYPEGMAVDWMGKNLYWADTGTNRIEVAR  745

747 LDGQFRQVLVWRDLDNPRSLALDPTKGYIYWTEWGGKPRIVRAFMDGTNC  796
     |||||||||||||||||||||||||||||||||||||||||||||||||
 746 LDGQFRQVLVWRDLDNPRSLALDPTKGYIYWTEWGGKPRIVRAFMDGTNC  795

797 MTLVDKVGRANDLTIDYADQRLYWTDLDTNMIESSNMLGQERVVIADDLP  846
     ||||||||||||||||||||||||||||||||||||||||||:||||||
 796 MTLVDKVGRANDLTIDYADQRLYWTDLDTNMIESSNMLGQERMVIADDLP  845

847 HPFGLTQYSDYIYWTDWNLHSIERADKTSGRNRTLIQGHLDFVMDILVFH  896
     .||||||||||||||||||||||||||||||||||||||||||||||||
 846 YPFGLTQYSDYIYWTDWNLHSIERADKTSGRNRTLIQGHLDFVMDILVFH  895

897 SSRQDGLNDCMHNNGQCGQLCLAIPGGHRCGCASHYTLDPSSRNCSPPTT  946
     ||||||||||:|.||||||||||||||||||||||||||||||||||.|
 896 SSRQDGLNDCVHSNGQCGQLCLAIPGGHRCGCASHYTLDPSSRNCSPPST  945

947 FLLFSQKSAISRMIPDDQHSPDLILPLHGLRNVKAIDYDPLDKFIYWVDG  996
     ||||||:|||||||||||:|||:||||||||||||:|||||||||||||
 946 FLLFSQKFAISRMIPDDQLSPDLVLPLHGLRNVKAINYDPLDKFIYWVDG  995

997 RQNIKRAKDDGTQPFVLTSLSQGQNPDRQPHDLSIDIYSRTLFWTCEATN 1046
     |||||||||||||:|||.||:.|||||||||||||||||||||||||||
 996 RQNIKRAKDDGTQPSMLTSPSQSLSPDRQPHDLSIDIYSRTLFWTCEATN 1045

1047 TINVHRLSGEAMGVVLRGDRDKPRAIVVNAERGYLYFTNMQDRAAKIERA 1096
     |||||||.|:|||||||||||||||.|||||||:||||||||:||||||
1046 TINVHRLDGDAMGVVLRGDRDKPRAIAVNAERGYMYFTNMQDHAAKIERA 1095

1097 ALDGTEREVLFTTGLIRPVALVVDNTLGKLFWVDADLKRIESCDLSGANR 1146
     :|||||||||||||||||||||||||.||||||||||||||||||||||
1096 SLDGTEREVLFTTGLIRPVALVVDNALGKLFWVDADLKRIESCDLSGANR 1145

1147 LTLEDANIVQPLGLTILGKHLYWIDRQQQMIERVEKTTGDKRTRIQGRVA 1196
     |||||||||||:|||:||:|||||||||||||||||||||||:||||:.
1146 LTLEDANIVQPVGLTVLGRHLYWIDRQQQMIERVEKTTGDKRTRVQGRVT 1195

1197 HLTGIHAVEEVSLEEFSAHPCARDNGGCSHICIAKGDGTPRCSCPVHLVL 1246
     |||||||||||||||||||||||||||||||||||||||||||||||||
1196 HLTGIHAVEEVSLEEFSAHPCARDNGGCSHICIAKGDGTPRCSCPVHLVL 1245

1247 LQNLLTCGEPPTCSPDQFACATGEIDCIPGAWRCDGFPECDDQSDEEGCP 1296
     |||||||||||||||||||||:.||||||||||||||||||||||||||
1246 LQNLLTCGEPPTCSPDQFACTTGEIDCIPGAWRCDGFPECADQSDEEGCP 1295

1297 VCSAAQFPCARGQCVDLRLRCDGEADCQDRSDEADCDAICLPNQFRCASG 1346
     ||||.||||||||||||||||||||||||||||:|||:||||||||.||
1296 VCSASQFPCARGQCVDLRLRCDGEADCQDRSDEANCDAVCLPNQFRCTSG 1345

1347 QCVLIKQQCDSFPDCIDGSDELMCEITKPPSDDSPAHSSAIGPVIGIILS 1396
     ||||||||||||||||.|||||||||.||||||.|||||||||||||||
1346 QCVLIKQQCDSFPDCADGSDELMCEINKPPSDDIPAHSSAIGPVIGIILS 1395

1397 LFVMGGVYFVCQRVVCQRYAGANGPFPHEYVSGTPHVPLNFIAPGGSQHG 1446
     |||||||||||||:||||||.||.|||||||.|.|||||||||||||||
1396 LFVMGGVYFVCQRVMCQRYTGASGPFPHEYVGGAPHVPLNFIAPGGSQHG 1445
```

FIG. 26C
Alignment of Human and Mouse Zmax1 (LRP5)
Amino-Acid Sequences.

```
1447 PFTGIACGKSMMSSVSLMGGRGGVPLYDRNHVTGASSSSSSSSTKATLYPP 1496
     ||.||:|:||:|||:||:||||:||||||||||||||||||||||||||
1446 PFPGIPCSKSVMSSMSLVGGRGSVPLYDRNHVTGASSSSSSSSTKATLYPP 1495

1497 ILNPPPSPATDPSLYNMDMFYSSNIPATARPYRPYIIRGMAPPTTPCSTD 1546
     ||||||||||||||:|:||||.||||||||||||||:||||||||||||
1496 ILNPPPSPATDPSLYNVDVFYSSGIPATARPYRPYVIRGMAPPTTPCSTD 1545

1547 VCDSDYSASRWKASKYYLDLNSDSDPYPPPPTPHSQYLSAEDSCPPSPAT 1596
     ||||||||.||||.|||||||||||||||||||||||||||||||||:|
1546 VCDSDYSISRWKSSKYYLDLNSDSDPYPPPPTPHSQYLSAEDSCPPSPGT 1595

1597 ERSYFHLFPPPPSPCTDSS 1615
     ||||.||||||||||||||
1596 ERSYCHLFPPPPSPCTDSS 1614
```

FIG. 27A

Alignment of Human LRP5 and LRP6

Top = LRP5, Bottom = LRP6

<u>Underlined</u> = region marked for antibody production

Percent Similarity: 83.542   Percent Identity: 70.901

```
  1 MEAAPPGPPWPLLLLLLLLLALCGCPAPAAASPLLLFANRRDVRLVDAGG  50
     :  :|   |||  |:  .    |.||||:|||||:|||||..
  1 ...........MGAVLRSLLA.CSFCVLLRAAPLLLYANRRDLRLVDATN  38

51 VKLESTIVVSGLEDAAAVDFQFSKGAVYWTDVSEEAIKQTYLNQTGAAVQ 100
    .| :.||||:|||||||||| ||.| :||.|||||||||.| :|.|: :||
 39 GKENATIVVGGLEDAAAVDFVFSHGLIYWSDVSEEAIKRTEFNKTE.SVQ  87

101 NVVISGLVSPDGLACDWVGKKLYWTDSETNRIEVANLNGTSRKVLFWQDL 150
    |||:|||:|||||||||||:|.||||||||||||||||||.||:|.||||||:|
 88 NVVVSGLLSPDGLACDWLGEKLYWTDSETNRIEVSNLDGSLRKVLFWQEL 137

151 DQPRAIALDP<u>AHGYMYWTDWGETPRIERAGMDGSTRKIIVDSDIYWPNGL</u> 200
    |||||||||:.||||||||||:|:|||||||||:::|.|||:|:|||||||
138 DQPRAIALDPSSGFMYWTDWGEVPKIERAGMDGSSRFIIINSEIYWPNGL 187

201 TIDLEEQKLYWADAKLSFIHRANLDGSFRQKVVEGSLTHPFALTLSGDTL 250
    |:|.|||||||||||||.|||:.||||.||  ||.|||.|||||||| :|.|
188 TLDYEEQKLYWADAKLNFIHKSNLDGTNRQAVVKGSLPHPFALTLFEDIL 237

251 YWTDWQTRSIHACNKRTGGKRKEILSALYSPMDIQVLSQERQPFFHTRCE 300
    ||||| |:|| |||| ||: :|| |.::|||||:.:||:|||    .|:
238 YWTDWSTHSILACNKYTGEGLREIHSDIFSPMDIHAFSQQRQPNATNPCG 287

301 EDNGGCSHLCLLSPSEPFYTCACPTGVQLQDNGRTCKAGAEEVLLLARRT 350
    |||||||||:|| .||| |||||||.| :||:|||.||.|:|||||||||
288 IDNGGCSHLCLMSPVKPFYQCACPTGVKLLENGKTCKDGATELLLLARRT 337

351 DLRRISLDTPDFTDIVLQVDDIRHAIAIDYDPLEGYVYWTDDEVRAIRRA 400
    |||||||||||||||||::|||||||||||||:|||:|||||||||||||
338 DLRRISLDTPDFTDIVLQLEDIRHAIAIDYDPVEGYIYWTDDEVRAIRRS 387

401 <u>YLDGSGAQTLVNTEINDPDGIAVDWVARNLYWTDGTDRIEVTRLNGTSR</u> 450
    ::||||.| :|...|..|||||||||||||||||||||||||||||| |
388 FIDGSGSQFVVTAQIAHPDGIAVDWVARNLYWTDGTDRIEVTRLNGTMR 437

451 KILVSEDLDEPRAIALHPVMGLMYWTDWGENPKIECANLDGQERRVLVNA 500
    |||:||||:||||:|.|:|.||||||||| |||| |.||| :| ||||.
438 KILISEDLEEPRAIVLDPMVGYMYWTDWGEIPKIERAALDGSDRVVLVNT 487

501 SLGWPNGLALDLQEGKLYWGDAKTDKIEVINVDGTKRRTLLEDKLPHIFG 550
    |||||||||||:|||:|||||||||||||||:.|||  ||.|:|||:||||
488 SLGWPNGLALDYDEGKIYWGDAKTDKIEVMNTDGTGRRVLVEDKIPHIFG 537

551 FTLLGDFIYWTDWQRRSIERVHKVKASRDVIIDQLPDLMGLKAVNVAKVV 600
    ||||||:|:||||||||||||||:.|:|:|||||||||||||.:|| :|
538 FTLLGDYVYWTDWQRRSIERVHKRSAEREVIIDQLPDLMGLKATNVHRVI 587

601 GTNPCADRNG<u>GCSHLCFFTPHATRCGCPIGLELLSDMKTCIVPEAFLVFT</u> 650
    |.||||  ||||||||||: |::|| :||||.| ||||||||||||||.
588 GSNPCAEENGGCSHLCLYRPQGLRCACPIGFELISDMKTCIVPEAFLLFS 637
```

FIG. 27B
Alignment of Human LRP5 and LRP6

```
 651 SRAAIHRISLETNNNDVAIPLTGVKEASALDFDVSNNHIYWTDVSLKTIS  700
     .||.|:||||||||.||||||||||||||||||..:|:|||||:|||||
 638 RRADIRRISLETNNNNVAIPLTGVKEASALDFDVTDNRIYWTDISLKTIS  687

701 RAFMNGSSVEHVVEFGLDYPEGMAVDWMGKNLYWADTGTNRIEVARLDGQ  750
     ||||||.:||||||||||||||||||:|||||||||||||||..:||||
 688 RAFMNGSALEHVVEFGLDYPEGMAVDWLGKNLYWADTGTNRIEVSKLDGQ  737

751 FRQVLVWRDLDNPRSLALDPTKGYIYWTEWGGKPRIVRAFMDGTNCMTLV  800
     ||||||||:|||.||.|||||..|::||||||||||.||.|||||.|||
 738 HRQVLVWKDLDSPRALALDPAEGFMYWTEWGGKPKIDRAAMDGSERTTLV  787

801 DKVGRANDLTIDYADQRLYWTDLDTNMIESSNMLGQERVVIADDLPHPFG  850
     ..||||||:||||||..||||||||||:|||||||:|.|:||||||||||
 788 PNVGRANGLTIDYAKRRLYWTDLDTNLIESSNMLGLNREVIADDLPHPFG  837

851 LTQYSDYIYWTDWNLHSIERADKTSGRNRTLIQGHLDFVMDILVFHSSRQ  900
     ||||.|||||||||.:|||||||||:||||.|||||||||:|||||||||
 838 LTQYQDYIYWTDWSRRSIERANKTSGQNRTIIQGHLDYVMDILVFHSSRQ  887

901 DGLNDCMHNNGQCGQLCLAIP.GGHRCGCASHYTLDPSSRNCSPPTTFLL  949
     .|:|:|..||:::|||:.|.|||||.|.||:|.|:::.|..||:||||||
 888 SGWNECASSNGHCSHLCLAVPVGGFVCGCPAHYSLNADNRTCSAPTTFLL  937

950 FSQKSAISRMIPDDQHSPDLILPLHGLRNVKAIDYDPLDKFIYWVDGRQN  999
     ||||||.||:|:|:|||:|||||:|||||:||||||||||:||:|:|||
 938 FSQKSAINRMVIDEQQSPDIILPIHSLRNVRAIDYDPLDKQLYWIDSRQN  987

1000 .IKRAKDDGTQPF.VLTSLSQGQNPDRQPHDLSIDIYSRTLFWTCEATNT 1047
     |::|.:||.|.|..:||.||.|||||||||||::|||||||.
 988 MIRKAQEDGSQGFTVVVSSVPSQNLEIQPYDLSIDIYSRYIYWTCEATNV 1037

1048 INVHRLSGEAMGVVLRGDRDKPRAIVVNAERGYLYFTNMQDRAAKIERAA 1097
     |||.||.|.:|||||||:|.|:||||||||:||:||||:|.::|||||||
1038 INVTRLDGRSVGVVLKGEQDRPRAIVVNPEKGYMYFTNLQERSPKIERAA 1087

1098 LDGTEREVLFTTGLIRPVALVVDNTLGKLFWVDADLKRIESCDLSGANRL 1147
     |||||||||.||.||.:|:||.:|.|||||.|.||:||||:|||||||:
1088 LDGTEREVLFFSGLSKPIALALDSRLGKLFWADSDLRRIESSDLSGANRI 1137

1148 TLEDANIVQPLGLTILGKHLYWIDRQQQMIERVEKTTGDKRTRIQGRVAH 1197
     .|||.||:||||||||||.|||||||||||||:..:|...||.|:||:||
1138 VLEDSNILQPVGLTVFENWLYWIDKQQQMIEKIDMTGREGRTKVQARIAQ 1187

1198 LTGIHAVEEVSLEEFSAHPCARDNGGCSHICIAKGDGTPRCSCPVHLVLL 1247
     |.:|||||:||.||.|||||:|||||||||:|:||||||:|||||:|||
1188 LSDIHAVKELNLQEYRQHPCAQDNGGCSHICLVKGDGTTRCSCPMHLVLL 1237

1248 QNLLTCGEPPTCSPDQFACATGEIDCIPGAWRCDGFPECDDQSDEEGCPV 1297
     |:.|.||||||||||||.|.||||||||||.|.|||||||||||||||||
1238 QDELSCGEPPTCSPQQFTCFTGEIDCIPVAWRCDGFTECEDHSDELNCPV 1287

1298 CSAAQFPCARGQCVDLRLRCDGEADCQDRSDEADCDAICLPNQFRCASGQ 1347
     ||..||:|.||||:||:|||||||||||:|||||||.:|:..||:||||||
1288 CSESQFQCASGQCIDGALRCNGDANCQDKSDEKNCEVLCLIDQFRCANGQ 1337

1348 CVLIKQQCDSFPDCIDGSDELMCEITKPPSDDSPAHSSAIGPVIGIILSL 1397
     |:.....|||:||:|||||||||:....:.....|||||||:|:|:|||
1338 CIGKHKKCDHNVDCSDKSDELDCYPTEEP...APQATNTVGSVIGVIVTI 1384
```

FIG. 27C
Alignment of Human LRP5 and LRP6

```
1398 FVMGGVYFVCQRVVCQRYAGANGPFPHEYVS.GTPHVPLNFIAPGGSQHG 1446
     || |.|||:|||::|.|  |.......::||  |.: |||.:::..:| |
1385 FVSGTVYFICQRMLCPRMKGDGETMTNDYVVHGPASVPLGYVPHPSSLSG 1434

1447 PFTGIACGKSMMSSVSLMGGRGGVPLYDRNHVTGASSSSSSSTKATLYPP 1496
     .:.|:. ||||:||:|:|||.:|.| |||.||||||||||||||:|.:|:
1435 SLPGMSRGKSMISSLSIMGGSSGPP.YDRAHVTGASSSSSSSTKGTYFPA 1483

1497 ILNPPPSPATDPSLYNMDMFYSSNIPATAR...PYRPYIIRGMAPPTTPCS 1544
     |||||||||:.| |.|:: |||| |.|.|   .|||| .| :||||||||
1484 ILNPPPSPATERSHYTMEFGYSSNSPSTHRSYSYRPYSYRHFAPPTTPCS 1533

1545 TDVCDSDYSASRWKAS.....:KYYLDLNSDSDPYPPPPTPHSQYLSAE.. 1587
     ||||||||.:||:..|     |  ||| ||:| ||||||:||||||||
1534 TDVCDSDYAPSRRMTSVATAKGYTSDLNYDSEPVPPPPTPRSQYLSAEEN 1583

1588 .DSCPPSPATERSY.FHLFPPPPSPCTDSS 1615
      :||||| |||||  ||:||||||||||||
1584 YESCPPSPYTERSYSHHLYPPPPSPCTDSS 1613
```

TRANSGENIC ANIMAL MODEL OF BONE MASS MODULATION

This application claims priority to International Application No. PCT/US02/14876, filed May 13, 2002, and the benefit of Provisional Application Nos. 60/290,071 filed May 11, 2001; 60/291,311 filed May 17, 2001; 60/353,058 filed Feb. 1, 2002, and 60/361,293 filed Mar. 4, 2002, the disclosures of each are herein incorporated by reference in their entirety for all purposes.

FIELD OF THE INVENTION

The present invention relates generally to the field of genetics, genomics and molecular biology. The invention relates to methods and materials used to isolate, detect and sequence a high bone mass gene and corresponding wild-type gene, and mutants thereof. The present invention also relates to the high bone mass (HBM) gene, the corresponding wild-type gene, and mutants thereof. The genes identified in the present invention are implicated in the ontology and physiology of bone development. The invention also provides nucleic acids, proteins, cloning vectors, expression vectors, transformed hosts, methods of developing pharmaceutical compositions, methods of identifying molecules involved in bone development, and methods of diagnosing and treating diseases involved in bone development. The invention further relates to transgenic animals for studying the HBM phenotype, the mechanism of action of the HBM gene, and factors and treatments affecting normal and abnormal bone conditions. In preferred embodiments, the present invention is directed to methods for treating, diagnosing, preventing and screening for normal and abnormal conditions of bone, including metabolic bone diseases such as osteoporosis.

BACKGROUND OF THE INVENTION

Two of the most common types of osteoporosis are postmenopausal and senile osteoporosis. Osteoporosis affects men as well as women, and, taken with other abnormalities of bone, presents an ever-increasing health risk for an aging population. The most common type of osteoporosis is that associated with menopause. Most women lose between 20-60% of the bone mass in the trabecular compartment of the bone within 3-6 years after the cessation of menses. This rapid loss is generally associated with an increase of bone resorption and formation. However, the resorptive cycle is more dominant and the result is a net loss of bone mass. Osteoporosis is a common and serious disease among postmenopausal women. There are an estimated 25 million women in the United States alone who are afflicted with this disease. The results of osteoporosis are both personally harmful, and also account for a large economic loss due to its chronicity and the need for extensive and long-term support (hospitalization and nursing home care) from the disease sequelae. This is especially true in more elderly patients. Additionally, while osteoporosis is generally not thought of as a life-threatening condition, a 20-30% mortality rate is related to hip fractures in elderly women. A large percentage of this mortality rate can be directly associated with postmenopausal osteoporosis.

The most vulnerable tissue in the bone to the effects of postmenopausal osteoporosis is the trabecular bone. This tissue is often referred to as spongy bone and is particularly concentrated near the ends of the bone near the joints and in the vertebrae of the spine. The trabecular tissue is characterized by small structures which inter-connect with each other as well as the more solid and dense cortical tissue which makes up the outer surface and central shaft of the bone. This criss-cross network of trabeculae gives lateral support to the outer cortical structure and is critical to the biomechanical strength of the overall structure. In postmenopausal osteoporosis, it is primarily the net resorption and loss of the trabeculae which lead to the failure and fracture of the bone. In light of the loss of the trabeculae in postmenopausal women, it is not surprising that the most common fractures are those associated with bones which are highly dependent on trabecular support, e.g., the vertebrae, the neck of the femur, and the forearm. Indeed, hip fracture, Colle's fractures, and vertebral crush fractures are indicative of postmenopausal osteoporosis.

One of the earliest generally accepted methods for treatment of postmenopausal osteoporosis was estrogen replacement therapy. Although this therapy frequently is successful, patient compliance is low, primarily due to the undesirable side-effects of chronic estrogen treatment. Frequently cited side-effects of estrogen replacement therapy include reinitiation of menses, bloating, depression, and fear of breast or uterine cancer. In order to limit the known threat of uterine cancer in those women who have not undergone a hysterectomy, a protocol of estrogen and progestin cyclic therapy is often employed. This protocol is similar to that which is used in birth control regimens, and often is not tolerated by women because of the side-effects characteristic of progestin. More recently, certain antiestrogens, originally developed for the treatment of breast cancer, have been shown in experimental models of postmenopausal osteoporosis to be efficacious. Among these agents is raloxifene (See, U.S. Pat. No. 5,393, 763, and Black et al., *J. Clin. Invest.*, 93:63-69 (1994)). In addition, tamoxifene, a widely used clinical agent for the treatment of breast cancer, has been shown to increase bone mineral density in post menopausal women suffering from breast cancer (Love et al., *N. Engl. J. Med.*, 326:852-856 (1992)).

Another therapy for the treatment of postmenopausal osteoporosis is the use of calcitonin. Calcitonin is a naturally occurring peptide which inhibits bone resorption and has been approved for this use in many countries (Overgaard et al., *Br. Med. J.*, 305:556-561 (1992)). The use of calcitonin has been somewhat limited, however. Its effects are very modest in increasing bone mineral density and the treatment is very expensive. Another therapy for the treatment of postmenopausal osteoporosis is the use of bis-phosphonates. These compounds were originally developed for use in Paget's disease and malignant hypercalcemia. They have been shown to inhibit bone resorption. Alendronate, one compound of this class, has been approved for the treatment of postmenopausal osteoporosis. These agents may be helpful in the treatment of osteoporosis, but these agents also have potential liabilities which include osteomalacia, extremely long half-life in bone (greater than 2 years), and possible "frozen bone syndrome," e.g., the cessation of normal bone remodeling.

Senile osteoporosis is similar to postmenopausal osteoporosis in that it is marked by the loss of bone mineral density and resulting increase in fracture rate, morbidity, and associated mortality. Generally, it occurs in later life, i.e., after 70 years of age. Historically, senile osteoporosis has been more common in females, but with the advent of a more elderly male population, this disease is becoming a major factor in the health of both sexes. It is not clear what, if any, role hormones such as testosterone or estrogen have in this disease, and its etiology remains obscure. Treatment of this disease has not been very satisfactory. Hormone therapy, estrogen in women and testosterone in men, has shown equivocal results; calcitonin and bis-phosphonates may be of some utility.

The peak mass of the skeleton at maturity is largely under genetic control. Twin studies have shown that the variance in bone mass between adult monozygotic twins is smaller than between dizygotic twins (Slemenda et al., *J. Bone Miner. Res.*, 6:561-567 (1991); Young et al., *J. Bone Miner. Res.*, 6:561-567 (1995); Pocock et al., *J. Clin. Invest.*, 80:706-710 (1987); Kelly et al., *J. Bone Miner. Res.*, 8:11-17 (1993)), and it has been estimated that up to 60% or more of the variance in skeletal mass is inherited (Krall et al., *J. Bone Miner. Res.*, 10:S367 (1993)). Peak skeletal mass is the most powerful determinant of bone mass in elderly years (Hui et al., *Ann. Int. Med.*, 111:355-361 (1989)), even though the rate of age-related bone loss in adult and later life is also a strong determinant (Hui et al., *Osteoporosis Int.*, 1:30-34 (1995)). Since bone mass is the principal measurable determinant of fracture risk, the inherited peak skeletal mass achieved at maturity is an important determinant of an individual's risk of fracture later in life. Thus, study of the genetic basis of bone mass is of considerable interest in the etiology of fractures due to osteoporosis.

Recently, a strong interest in the genetic control of peak bone mass has developed in the field of osteoporosis. The interest has focused mainly on candidate genes with suitable polymorphisms to test for association with variation in bone mass within the normal range, or has focused on examination of genes and gene loci associated with low bone mass in the range found in patients with osteoporosis. The vitamin D receptor locus (VDR) (Morrison et al., *Nature*, 367:284-287 (1994)), PTH gene (Howard et al., *J. Clin. Endocrinol. Metab.*, 80:2800-2805 (1995); Johnson et al., *J. Bone Miner. Res.*, 8:11-17 (1995); Gong et al., *J. Bone Miner. Res.*, 10:S462 (1995)) and the estrogen receptor gene (Hosoi et al., *J. Bone Miner. Res.*, 10:S170 (1995); Morrison et al., *Nature*, 367:284-287 (1994)) have figured most prominently in this work. These studies are difficult because bone mass (the phenotype) is a continuous, quantitative, polygenic trait, and is confounded by environmental factors such as nutrition, co-morbid disease, age, physical activity, and other factors. Also, this type of study design requires large numbers of subjects. In particular, the results of VDR studies to date have been confusing and contradictory (Garnero et al., *J. Bone Miner. Res.*, 10:1283-1288 (1995); Eisman et al., *J. Bone. Miner. Res.*, 10:1289-1293 (1995); Peacock, *J. Bone Miner. Res.*, 10:1294-1297 (1995)). Furthermore, the work thus far has not shed much light on the mechanism(s) whereby the genetic influences might exert their effect on bone mass.

While it is well known that peak bone mass is largely determined by genetic rather than environmental factors, studies to determine the gene loci (and ultimately the genes) linked to variation in bone mass are difficult and expensive. Study designs which utilize the power of linkage analysis, e.g., sib-pair or extended family, are generally more informative than simple association studies, although the latter do have value. However, genetic linkage studies involving bone mass are hampered by two major problems. The first problem is the phenotype, as discussed briefly above. Bone mass is a continuous, quantitative trait, and establishing a discrete phenotype is difficult. Each anatomical site for measurement may be influenced by several genes, many of which may be different from site to site. The second problem is the age component of the phenotype. By the time an individual can be identified as having low bone mass, there is a high probability that their parents or other members of prior generations will be deceased and therefore unavailable for study, and younger generations may not have even reached peak bone mass, making their phenotyping uncertain for genetic analysis.

Regardless, linkage analysis can be used to find the location of a gene causing a hereditary "disorder" and does not require any knowledge of the biochemical nature of the disorder, i.e., a mutated protein that is believed to cause the disorder does not need to be known. Traditional approaches depend on assumptions concerning the disease process that might implicate a known protein as a candidate to be evaluated. The genetic localization approach using linkage analysis can be used to first find the general chromosomal region in which the defective gene is located and then to gradually reduce the size of the region in order to determine the location of the specific mutated gene as precisely as possible. After the gene itself is discovered within the candidate region, the messenger RNA and the protein are identified and, along with the DNA, are checked for mutations.

The genetic localization approach has practical implications since the location of the disease can be used for prenatal diagnosis even before the altered gene that causes the disease is found. Linkage analysis can enable families, even many of those that do not have a sick child, to know whether they are carriers of a disease gene and to evaluate the condition of an unborn child through molecular diagnosis. The transmission of a disease within families, then, can be used to find the defective gene. As used herein, reference to "high bone mass" (HBM) is analogous to reference to a disease state, although from a practical standpoint high bone mass can actually help a subject avoid the disease known as osteoporosis.

Linkage analysis is possible because of the nature of inheritance of chromosomes from parents to offspring. During meiosis, the two parental homologues pair to guide their proper separation to daughter cells. While they are lined up and paired, the two homologues exchange pieces of the chromosomes, in an event called "crossing over" or "recombination." The resulting chromosomes are chimeric, that is, they contain parts that originate from both parental homologues. The closer together two sequences are on the chromosome, the less likely that a recombination event will occur between them, and the more closely linked they are. In a linkage analysis experiment, two positions on the chromosomes are followed from one generation to the next to determine the frequency of recombination between them. In a study of an inherited disease, one of the chromosomal positions is marked by the disease gene or its normal counterpart, i.e., the inheritance of the chromosomal region can be determined by examining whether the individual displays symptoms of the disorder or not. The other position is marked by a DNA sequence that shows natural variation in the population such that the two homologues can be distinguished based on the copy of the "marker" sequence that they possess. In every family, the inheritance of the genetic marker sequence is compared to the inheritance of the disease state. If, within a family carrying an autosomal dominant disorder such as high bone mass, every affected individual carries the same form of the marker and all the unaffected individuals carry at least one different form of the marker, there is a great probability that the disease gene and the marker are located close to each other. In this way, chromosomes may be systematically checked with known markers and compared to the disease state. The data obtained from the different families is combined, and analyzed together by a computer using statistical methods. The result is information indicating the probability of linkage between the genetic marker and the disease allowing different distances between them. A positive result can mean that the disease is very close to the marker, while a negative result indicates that it is far away on that chromosome, or on an entirely different chromosome.

Linkage analysis is performed by typing all members of the affected family at a given marker locus and evaluating the co-inheritance of a particular disease state with the marker probe, thereby determining how often the two of them are co-inherited. The recombination frequency can be used as a measure of the genetic distance between two gene loci. A recombination frequency of 1% is equivalent to 1 map unit, or 1 centiMorgan (cM), which is roughly equivalent to 1,000 kb of DNA. This relationship holds up to frequencies of about 20% or 20 cM.

The entire human genome is 3,300 cM long. In order to find an unknown disease gene within 5-10 cM of a marker locus, the whole human genome can be searched with roughly 330 informative marker loci spaced at approximately 10 cM intervals (Botstein et al., *Am. J. Hum. Genet.*, 32:314-331 (1980)). The reliability of linkage results is established by using a number of statistical methods. The method most commonly used for the analysis of linkage in humans is the LOD score method (Morton, *Prog. Clin. Biol. Res.*, 147:245-265 (1984), Morton et al., *Am. J. Hum. Genet.*, 38:868-883 (1986)) which was incorporated into the computer program, LIPED, by Ott, *Am. J. Hum. Genet.*, 28:528-529 (1976). LOD scores are the logarithm of the ratio of the likelihood that two loci are linked at a given distance to that they are not linked (>50 cM apart). The advantage of using logarithmic values is that they can be summed among families with the same disease. This becomes necessary given the relatively small size of human families.

By convention, a total LOD score greater than +3.0 (that is, odds of linkage at the specified recombination frequency being 1000 times greater than odds of no linkage) is considered to be significant evidence for linkage at that particular recombination frequency. A total LOD score of less than −2.0 (that is, odds of no linkage being 100 times greater than odds of linkage at the specified frequency) is considered to be strong evidence that the two loci under consideration are not linked at that particular recombination frequency. Until recently, most linkage analyses have been performed on the basis of two-point data, which is the relationship between the disorder under consideration and a particular genetic marker. However, as a result of the rapid advances in mapping the human genome over the last few years, and concomitant improvements in computer methodology, it has become feasible to carry out linkage analyses using multi-point data. Multi-point analysis provide a simultaneous analysis of linkage between the disease and several linked genetic markers, when the recombination distance among the markers is known.

Multi-point analysis is advantageous for two reasons. First, the informativeness of the pedigree is usually increased. Each pedigree has a certain amount of potential information, dependent on the number of parents heterozygous for the marker loci and the number of affected individuals in the family. However, few markers are sufficiently polymorphic as to be informative in all those individuals. If multiple markers are considered simultaneously, then the probability of an individual being heterozygous for at least one of the markers is greatly increased. Second, an indication of the position of the disease gene among the markers may be determined. This allows identification of flanking markers, and thus eventually allows isolation of a small region in which the disease gene resides. Lathrop et al., *Proc. Natl. Acad. Sci. USA*, 81:3443-3446 (1984) have written the most widely used computer package, LINKAGE, for multi-point analysis.

There is a need in the art for identifying the gene associated with a high bone mass phenotype. There is also a need for tools for the study of the high bone mass gene and phenotype. More generally there is need for the development of diagnostic tools and treatments. The present invention is directed to these, as well as other, important ends.

SUMMARY OF THE INVENTION

The present invention describes the identification of the LRP5 gene and the HBM allele of the LRP5 gene on chromosome 11q13.3 by genetic linkage and mutation analysis. The LRP5 gene and the LRP5 protein which it encodes have previously been referred to as Zmax1 and Zmax1 (also Zmax) by the inventors and coworkers. The gene and its product have also been referred to by others using the designation LR3. It is understood that Zmax, Zmax1, LRP5, and LR3 are synonymous terms. The use of genetic markers linked to the genes has aided their discovery. By using linkage analysis and mutation analysis, persons predisposed to HBM may be readily identified. Cloning methods using Bacterial Artificial Chromosomes have enabled the inventors to focus on the chromosome region of 11q13.3 and to accelerate the sequencing of the autosomal dominant gene. In addition, the invention identifies the LRP5 gene and the HBM gene, and identifies the guanine-to-thymine polymorphism mutation at position 582 in the LRP5 gene that produces the HBM gene and the HBM phenotype.

The present invention identifies the LRP5 gene and the HBM gene, which can be used to determine if people are predisposed to HBM and, therefore, not susceptible to diseases characterized by reduced bone density, including, for example, osteoporosis, or are predisposed and susceptible to diseases characterized by abnormally high bone density, such as, for example, osteopetrosis. Older individuals carrying the HBM gene express the HBM protein, and, therefore, do not develop osteoporosis. In other words, the HBM gene is a suppressor of osteoporosis. This in vivo observation is a strong evidence that treatment of normal individuals with the HBM gene or protein, or fragments thereof, will ameliorate osteoporosis.

The present invention provides expression vectors for LRP5 and HBM which are useful for the study of bone density modulation in animal models. The expression vectors comprise promoters which drive the expression of LRP5 and HBM ubiquitously in animal tissues and specifically in bone tissues. The expression vectors also serve to provide linear nucleic acid sequences for the creation of transgenic and other genetically modified animals.

One embodiment provides vectors for gene targeting in mice and other animals for the purpose of creating knock-out mice which do not express LRP5 and knock-in mice which express the homologous mouse HBM protein. A conditional knock-out/knock-in vector is provided which allows in-vitro deletion of a knock-out cassette in pre-fusion zygotes. The present invention provides animal embryonic stem cells which comprise recombinant DNA of the gene targeting vectors.

In another embodiment, animal cells expressing LRP5 and HBM are provided for use in investigating modulators of bone density.

Yet another embodiment provides transgenic animals expressing the LRP5 gene and the HBM gene or other related variants under the control of general promoters and bone specific promoters. Transgenic animals are also provided wherein either the endogenous LRP5 gene or a heterologous LRP5 or HBM gene is under the control of inducible or conditional promoters such as for example the GENESWITCH® System. The present invention provide methods using these animals for the study of the HBM phenotype and its molecular mechanism, for the development of diagnostic and screening tools, and for the testing and development of treatments and therapeutic compounds.

Moreover, such treatment will be indicated in the treatment of bone lesions, particularly bone fractures, for bone remodeling in the healing of such lesions. For example, persons predisposed to or suffering from stress fractures (i.e., the accumulation of stress-induced microfractures, eventually resulting in a true fracture through the bone cortex) may be identified and/or treated by means of the invention. Moreover, the methods and compositions of the invention will be of use in the treatment of secondary osteoporosis, where the course of therapy involves bone remodeling, such as endocrine conditions accompanying corticosteroid administration, hyperthyroidism, hypogonadism, hematologic malignancies, malabsorption and alcoholism, as well as disorders associated with vitamin D and/or phosphate metabolism, such as osteomalacia and rickets, and diseases characterized by abnormal or disordered bone remodeling, such as Paget's disease, and in neoplasms of bone, which may be benign or malignant.

In various embodiments, the present invention is directed to nucleic acids, proteins, vectors, transformed hosts expressing HBM and LRP5, and transgenic animals carrying the human HBM and LRP5 genes and related variants, knock-in animals for HBM homologues or knock-out animals for these genes.

Additionally, the present invention is directed to applications of the above embodiments of the invention including, for example, gene therapy, pharmaceutical development, and diagnostic assays for bone development disorders. In preferred embodiments, the present invention is directed to methods for treating, diagnosing, preventing and screening for osteoporosis.

Another aspect of the invention is to provide transgenic animals having somatic and/or germ cells comprising a nucleic acid which comprises a promoter region that directs protein expression in animal and/or human cells operably linked to a sequence comprising at least 15 contiguous nucleotides of SEQ ID NO: 2 including at least the thymine at position 582 of SEQ ID NO: 2.

Other embodiments contemplated includes a transgenic animal having somatic and/or germ cells comprising a nucleic acid which comprises a sequence which encodes SEQ ID NO: 4 and which includes at least a codon for the valine corresponding to the valine at position 171 of SEQ ID NO: 4, and wherein the nucleic acid further comprises an operably linked promoter region that directs protein expression in animal and/or human cells; and, a transgenic animal for the study of bone density modulation having somatic and/or germ cells comprising a nucleic acid which comprises a promoter region that directs protein expression in animal and/or human cells operably linked to a sequence comprising at least 15 contiguous nucleotides of SEQ ID NO: 1. Also contemplated are the progeny of such animals. The animals are preferably mice, but can include any non-human animal (e.g., primates, canines, felines, rodents, ovines, bovines, and the like).

In any of these transgenic animals, the promoter region can be, for example, CMV, RSV, SV40, and EF-1a, CMVβActin, histone, type I collagen, TGFβ1, SX2, c-fos/c-jun, Cbfa1, Fra/Jun, D1X5, osteocalcin, osteopontin, bone sialoprotein, or collagenase promoter regions. The promoter region can be a bone specific promoter region. Thus, in a transgenic animal expressing human HBM, the human HBM protein can preferably be expressed greatest in bone tissue. Transgenic animals expressing a gene carrying a HBM mutation can exhibit a HBM phenotype, such as an animal wherein bone mass is modulated relative to a non-transgenic animal of the same species in more than one parameter selected from among the parameters of bone density, bone strength, trabecular number, bone size, and bone tissue connectivity.

A transgenic animal expressing a human HBM protein can be fertile and pass the human HBM gene to its offspring. Likewise, in an animal wherein a human LRP5 protein is expressed, the transgenic animal can be fertile and pass the human LRP5 gene to its offspring. Thus, the invention also provides for a transgenic animal produced from the transgenic animals above or their offspring.

In another aspect, the invention provides a transgenic mouse having a genome comprising an alteration of the gene encoding LRP5 wherein the alteration is caused by the introduction of a nucleic acid for gene targeting by homologous recombination into embryonic stem cells or pluripotent cells comprising a first section homologous to mouse LRP5 gene and a second section homologous to another section of mouse LRP5 gene, and between the first and the second section a middle section comprising an engineered deletion of a portion of the LRP5 gene, a nucleic acid sequence change, or a nucleic acid insertion, and wherein the nucleic acid is capable of homologous recombination with the endogenous gene.

Such animals are useful for the study of bone density or bone mass modulation and the development of methods and treatments for affecting bone density or bone mass modulation. Modulation of bone density and/or bone mass can be assessed by changes in one or more parameters such as bone mineral density, bone strength, trabecular number, bone size, and bone tissue connectivity.

Another object of the invention is to provide an animal embryo comprising a nucleic acid which comprises a promoter region that directs protein expression in animal and/or human cells operably linked to a sequence comprising at least 15 contiguous nucleotides of SEQ ID NO: 2 including at least the thymine at position 582 of SEQ ID NO: 2.

It is a further object of the invention to provide a nucleic acid for gene targeting by homologous recombination comprising a first section homologous to mouse LRP5 gene and a second section homologous to another section of mouse LRP5 gene, and between the first and the second section a middle section comprising an engineered deletion of a portion of the LRP5 gene, a nucleic acid sequence change, or a nucleic acid insertion, and wherein the nucleic acid is capable of homologous recombination with the endogenous gene.

Another object of the invention is to provide a method of producing a transgenic animal, and preferably a transgenic mouse, whose genome comprises an alteration of the gene encoding LRP5. This method can comprise:

(a) providing the a nucleic acid of which encodes LRP5 or HBM;

(b) introducing the nucleic acid into mouse embryonic stem cells;

(c) selecting those embryonic stem cells that comprise the nucleic acid;

(d) introducing an embryonic stem cells of step (c) into a mouse blastocyst;

(e) transferring the blastocyst of step (d) to a pseudopregnant mouse; and (f) allowing the transferred blastocyst to develop into a mouse chimeric for the nucleic acid.

In another aspect of the invention, the animals obtained as described can then be further bred by for example, breeding the chimeric mouse to a wild-type mouse to obtain mice heterozygous for the alteration; and breeding the heterozygous mice to generate mice homozygous for the alteration.

Another aspect of the invention is to provide a method for identifying agents which modulate HBM expression comprising the steps of: (a) providing cells derived from a transgenic animal as described above; (b) exposing the cells to a test compound; and (c) measuring the expression of HBM.

It is another object of the invention to study bone mass modulators by (a) providing a first group of transgenic animals as described above; (b) administering a test compound; and (c) measuring at least one parameter of development in the animals administered a test compound. Test compounds can include but are not limited to a hormone, a growth factor, a peptide, RNA, DNA, a mineral, a vitamin, a natural product, or a synthetic organic compound.

In another aspect, bone mass modulation and bone development can be studied by a method utilizing a group of transgenic animals, as described above, administering an experimental procedure to the animals, and measuring a parameter of development. Experimental procedures include, for example, ovariectomy, restricted bone loading, and increased bone loading.

Another aspect of the invention provides a reagent set for quantifying human LRP5 mRNA or HBM mRNA comprising the isolated nucleic acid sequences (SEQ ID NOS: 689-697):

```
(1)  5'-GTCAGCCTGGAGGAGTTCTCA-3';

5'-TCACCCTTGGCAATACAGATGT-3'; and,

6-FAM-5'-CCCACCCATGTGCCCGTGACA-3'; or (2)  5'-CGTGATTGCCGACGATCTC-3';

5'-TTCCGGCCGCTAGTCTTGT-3'; and,

6-FAM-5'-CGCACCCGTTCGGTCTGACGCAGTAC-3'.
```

Another reagent set includes

```
5'-CTTTCCCCACGAGTATGTTGGT-3'; and,

5'-AAGGGACCGTGCTGTGAGC-3'; and,

6-FAM-5'-AGCCCCTCATGTGCCTCTCAACTTCATAG-3'.
```

Another aspect of the invention provides for variants of SEQ ID NO:3 which contain one or more of the following amino acid substitutions: G171V, A214V, E128V, A65V, G199V, M282V, G479V, G781V, Q1087V, G171K, G171F, G171I, G171Q. The invention provides further variants of LPR5 in humans and other animals determined according to the methods described herein. It is another object of the invention to provide for corresponding variants in LRP6. For example, a preferred variant of LRP6 includes a G158V substitution.

It is yet a further embodiment of the invention to provide a method for studying HBM related effects on other bone disorders comprising the steps of: (a) providing embryos of animals with a bone disorder phenotype; (b) introducing the nucleic acid of encoding LRP5, LRP6, HBM, and/or a variant thereof into a first group of the embryos; (c) transferring the embryos to pseudopregnant mice; and, (d) measuring at least one parameter of development in the resultant mice. The nucleic acid can originate from any animal and is not limited to the human LRP5 or human HBM.

Another aspect of the invention provides a method for studying cardiac health effects related to LRP5, LRP6 or HBM comprising the steps of: (a) providing a first group of transgenic animals as described above and (b) measuring at least one parameter of cardiac health in the animals administered a test compound. In a further method, these animals can be used in a screen of putative cardiac drugs for efficacy, for example in identifying compounds that mimic the HBM effect on cardiac health.

It is yet another embodiment of the invention to provide methods of evaluating cardio-protective treatments for bone mass modulation effects comprising providing a first group of transgenic animals as described above; administering a cardio-protective treatment to a subgroup of the first group the first group of animals; and measuring at least one parameter of bone modulation in at least the treated mice.

Another aspect of the invention is to provide a method for studying modulators of bone mass comprising the steps of: (a) providing a first group of animals having somatic and/or germ cells comprising a nucleic acid which comprises a promoter region that directs protein expression in animal and/or human cells operably linked to a sequence comprising at least 15 contiguous nucleotides of SEQ ID NO: 1; (b) administering a test compound; and (c) measuring at least one parameter of bone development in the animals administered a test compound.

In alternative aspects of this method, a group of animals may alternatively comprise a promoter region operably linked to a transgenic sequence encoding LRP5, LRP6, HBM, or a variant thereof as described herein. Such methods are useful, for example, for screening a set of compounds to identify one or more compounds that replicate the HBM phenotype in a non-HBM animal, or to identify combinations of compounds that can function synergistically with compounds that replicate the HBM effect.

Another aspect is to provide a method for studying the effect of an experimental procedure on bone mass comprising the steps of: (a) providing a first group of animals having somatic and/or germ cells comprising a nucleic acid which comprises a promoter region that directs protein expression in animal and/or human cells operably linked to a sequence comprising at least 15 contiguous nucleotides of SEQ ID NO: 1; (b) administering an experimental procedure; and (c) measuring at least one parameter of bone mass to assess bone modulation in the animals administered an experimental procedure.

In alternative aspects of this method, a group of animals may alternatively comprise a promoter region operably linked to a transgenic sequence encoding LRP5, LRP6, HBM, or a variant thereof as described herein. Such methods are useful, for example, for screening experimental procedures to identify one or more compounds that replicate the HBM phenotype in a non-HBM animal, or to identify combinations of compounds and experimental procedures that can function synergistically to enhance the HBM effect.

Thus, methods provided by the present invention for making and using transgenic animal model systems related to the HBM phenotype include the following: A method for studying bone mass development using a transgenic animal model system comprising the steps of: (a) providing a first group of animals selected from among (i) animals comprising a transgene for expressing LRP5, LRP6 or HBM, (ii) animals in which the native LRP5 or LRP6 gene has been modified to express HBM or another variant or to prevent or modulate the expression of LRP5 or LRP6, or (iii) animals in which expression of LRP5 or LRP6 is otherwise disrupted or modulated; and (b) measuring at least one parameter of bone development in the animals.

This method can further comprise a step of administering a test compound to at least some of the animals prior to measuring at least one parameter of bone development in the animals, and/or further comprising a step of administering an experimental procedure to at least some of the animals prior to measuring at least one parameter of bone development in the animals. The test compound can be administered, for example, by injection, orally, by suppositories, in an implant, or topically. The experimental procedure can be chosen, for example, from among an ovariectomy, restricted bone loading, and increased bone loading. The test compound can comprise, for example, a hormone, a growth factor, a peptide, an RNA, a DNA, a mineral, a vitamin, a natural product, or a synthetic organic compound. The experimental procedure can comprise a surgical procedure, a gene therapy procedure, a drug therapy procedure, a dietary regimen, or physical exercise.

The invention also provides a method for identifying surrogate markers of bone formation/resorption comprising the steps of: (a) providing a first group of animals selected from among (i) animals comprising a transgene for expressing LRP5, LRP6 or HBM, (ii) animals in which the native LRP5 or LRP6 gene has been modified to express HBM or another variant or to prevent or modulate the expression of LRP5 or LRP6, or (iii) animals in which expression of LRP5 or LRP6 is otherwise disrupted or modulated; (b) providing a group of control animals; (c) measuring quantitatively a candidate surrogate marker in the animals; and, (d) comparing the measurements of a group of transgenic animals to measurements of the group of control animals.

Further, a method for studying effects of the HBM gene on cardiac disorders is provided, comprising the steps of: (a) providing a first group of transgenic animals selected from among (i) animals comprising a transgene for expressing LRP5, LRP6 or HBM, (ii) animals in which the native LRP5 or LRP6 gene has been modified to express HBM or another variant or to prevent or modulate the expression of LRP5 or LRP6, or (iii) animals in which expression of LRP5 or LRP6 is otherwise disrupted or modulated; and (b)measuring at least one parameter of cardiac health in the first group of animals administered a test compound. In addition, the invention provides a method for studying effects of a test compound and the HBM gene on cardiac disorders comprising the steps of the above method, and further comprising a step of administering a test compound to at least some of the animals prior to measuring at least one parameter of cardiac health in the first group of animals administered a test compound; and wherein the test compound comprises a hormone, a growth factor, a peptide, RNA, DNA, a mineral, a vitamin, a natural product, or a synthetic organic compound. As an example, the parameter of cardiac health can be blood serum lipid concentration.

There is also provided, a method of screening cardio-protective treatments for bone mass modulation effects comprising steps of the above method of using a transgenic animal model system for studying bone mass modulation, and further comprising the step of administering a cardio-protective treatment to a subgroup of the first group of animals.

A method for identification of genes associated with bone mass is also provided comprising the steps of: (a) providing an animal model of bone development comprising a first group of animals selected from among (i) animals comprising a transgene for expressing LRP5, LRP6 or HBM, (ii) animals in which the native LRP5 or LRP6 gene has been modified to express HBM or another variant or to prevent or modulate the expression of LRP5 or LRP6, or (iii) animals in which expression of LRP5 or LRP6 is otherwise disrupted or modulated; (b) providing a group of control animals; (c) measuring a profile of gene expression in the animals; and, (d) comparing the measurements of a the first group of animals to measurements of the control group of animals.

These and other aspects of the present invention are described in more detail below.

BRIEF DESCRIPTION OF THE FIGURES

FIGS. 2A and 2B depict the BAC/STS content physical map of the HBM region in 11q13.3. STS markers derived from genes, ESTs, microsatellites, random sequences, and BAC endsequences are denoted above the long horizontal line. For markers that are present in GDB the same nomenclature has been used. Locus names (D11S####) are listed in parentheses after the primary name if available. STSs derived from BAC endsequences are listed with the BAC name first followed by L or R for the left and right end of the clone, respectively. The two large arrows indicate the genetic markers that define the HBM critical region. The horizontal lines below the STSs indicate BAC clones identified by PCR-based screening of a nine-fold coverage BAC library. Open circles indicate that the marker did not amplify the corresponding BAC library address during library screening. Clone names use the following convention: B for BAC, the plate, row and column address, followed by -H indicating the HBM project (i.e., B36F16-H).

FIGS. 3A-3F show the genomic structure of LRP5 (Zmax1) with flanking intron sequences. Translation is initiated by the underlined "ATG" in exon 1. The site of the polymorphism in the HBM gene is in exon 3 and is represented by the underlined "G," whereby this nucleotide is a "T" in the HBM gene. The 3' untranslated region of the mRNA is underlined within exon 23 (exon 1, SEQ ID NO:40; exon 2, SEQ ID NO:41; exon 3, SEQ ID NO:42; exon 4, SEQ ID NO:43; exon 5, SEQ ID NO:44; exon 6, SEQ ID NO:45; exon 7, SEQ ID NO:46; exon 8, SEQ ID NO:47; exon 9, SEQ ID NO:48; exon 10, SEQ ID NO:49; exon 11, SEQ ID NO:50; exon 12, SEQ ID NO:51; exon 13, SEQ ID NO:52; exon 14, SEQ ID NO:53; exon 15, SEQ ID NO:54; exon 16, SEQ ID NO:55; exon 17, SEQ ID NO:56; exon 18, SEQ ID NO:57; exon 19, SEQ ID NO:58; exon 20, SEQ ID NO:59; exon 21, SEQ ID NO:60; exon 22, SEQ ID NO:61; and exon 23; SEQ ID NO:62).

FIG. 4 also shows the site of the glycine to valine change that occurs in the HBM protein. The signal peptide is located at amino acids 1-31, the extracellular domain is located at amino acids 32-1385, the transmembrane segment is located at amino acids 1386-1413, and the cytoplasmic domain is located at amino acids 1414-1615.

FIGS. 6A-6J show the nucleotide (SEQ ID NO: 1) and amino acid (SEQ ID NO: 3) sequences of the wild-type gene, LRP5. The location for the base pair substitution at nucleotide 582, a guanine to thymine, (SEQ ID NOS: 2, 4) is underlined.

This allelic variant is the HBM gene. The HBM gene encodes for a protein with an amino acid substitution of glycine to valine at position 171. The 5' untranslated region (UTR) boundaries bases 1 to 70, and the 3' UTR boundaries bases 4916-5120.

Figure 7B:
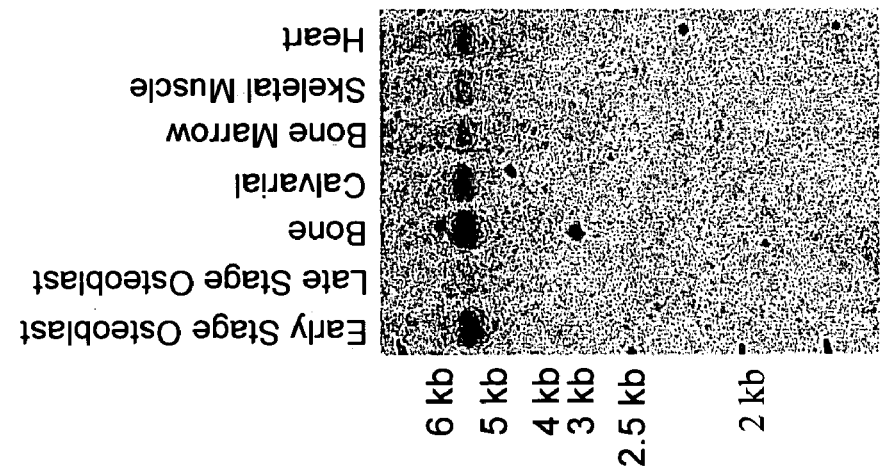
Figure 7A:
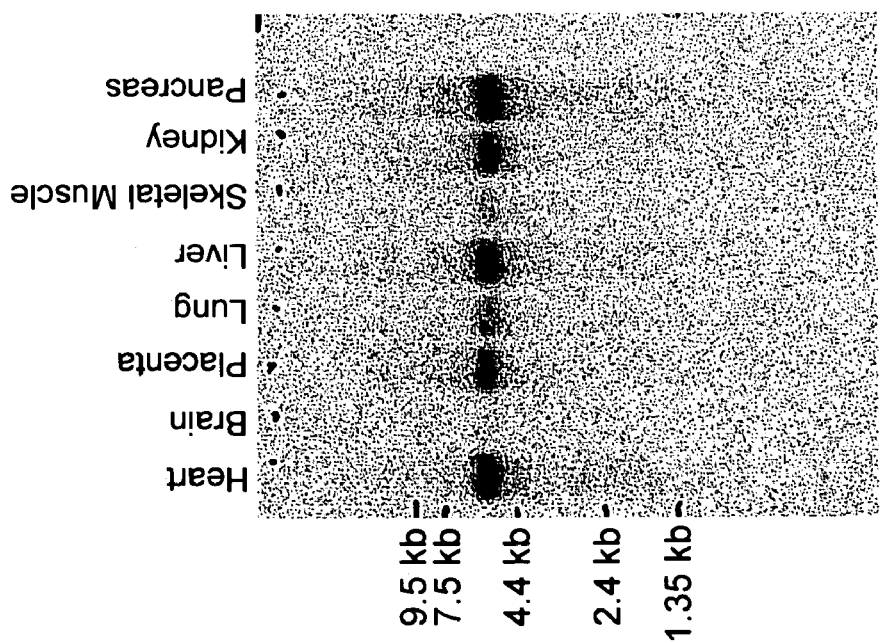

FIGS. 7A and 7B are northern blot analysis showing the expression of LRP5 (Zmax1) in various tissues.

Figure 8:
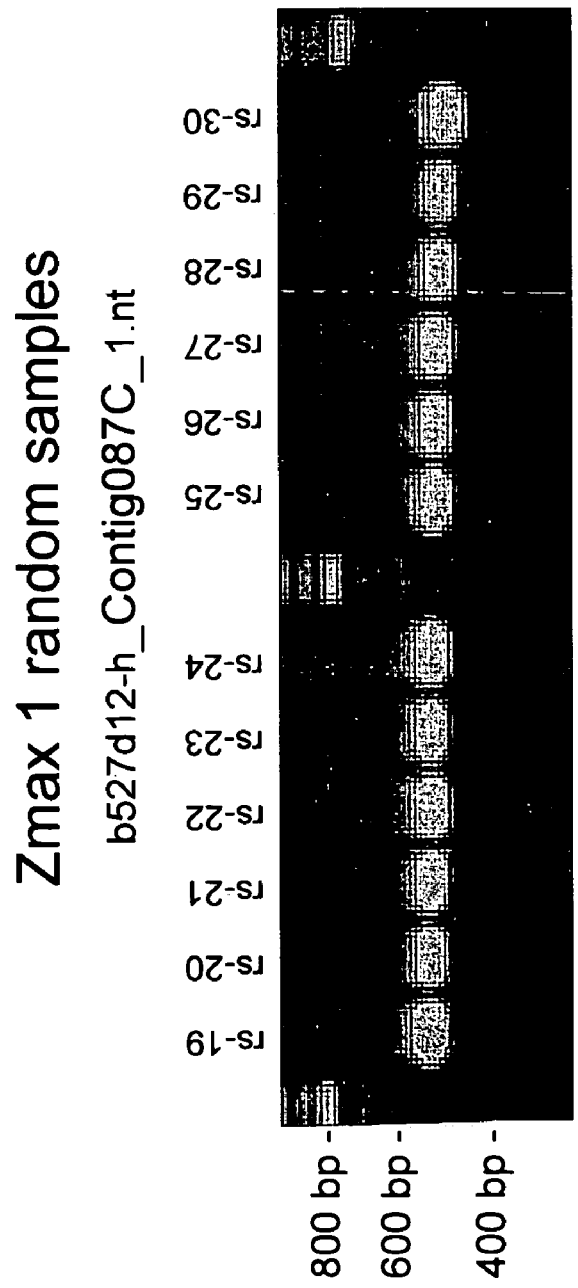

FIG. 8 is a PCR product analysis.

Figure 9:
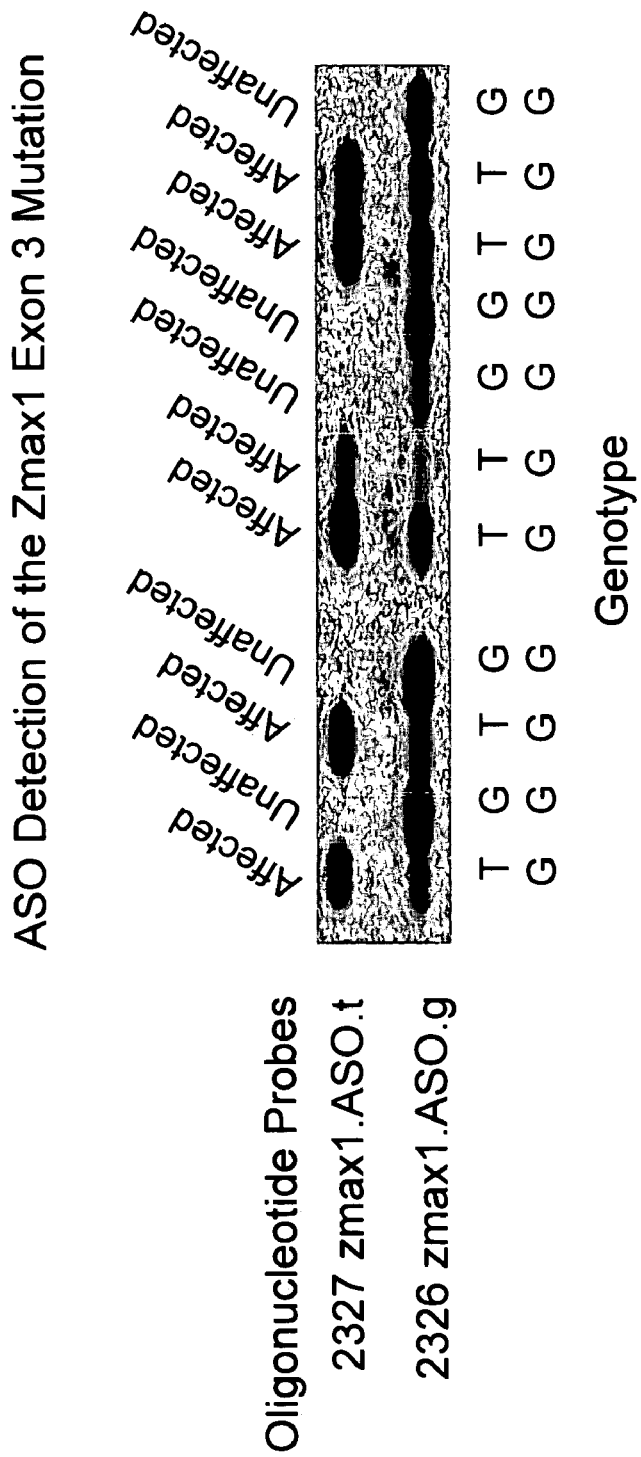

FIG. 9 is allele specific oligonucleotide detection of the LRP5 (Zmax1) exon 3 mutation.

Figure 10A:
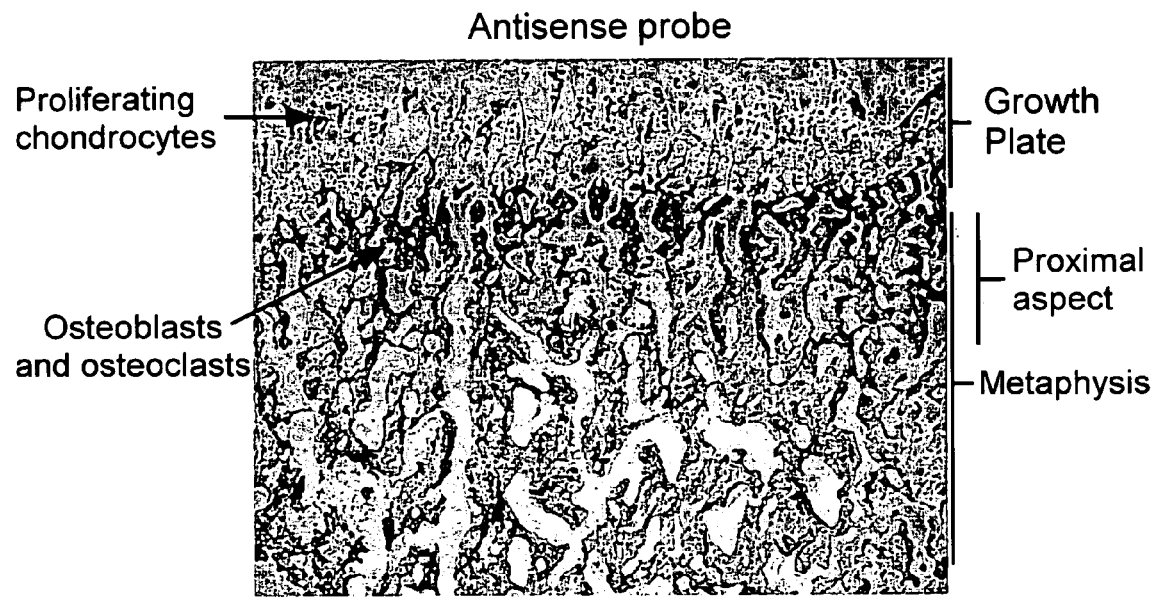
Figure 10B:
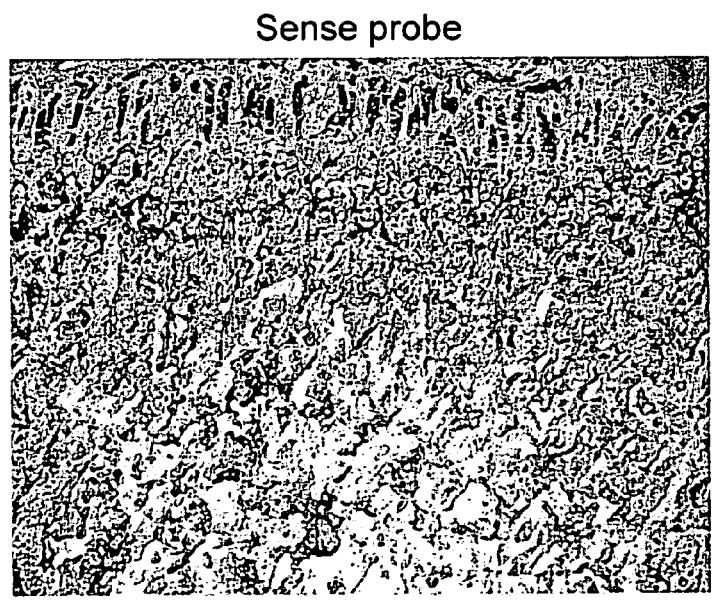

FIGS. 10A and 10B show the cellular localization of mouse LRP5 (Zmax1) by in situ hybridization at 100× magnification using sense and antisense probes.

Figure 11A:
Figure 11B:

FIGS. 11A and 11B show the cellular localization of mouse LRP5 (Zmax1) by in situ hybridization at 400× magnification using sense and antisense probes.

Figure 12A:
Figure 12B:
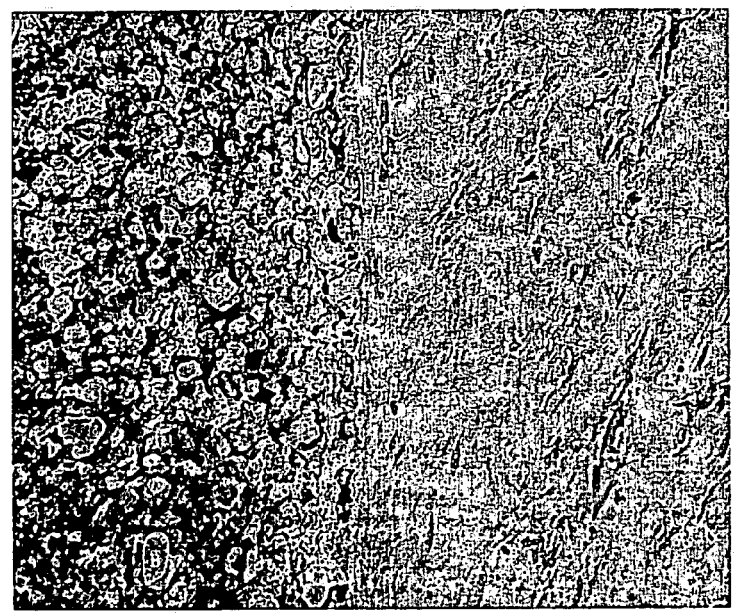

FIGS. 12A and 12B show the cellular localization of mouse LRP5 (Zmax1) by in situ hybridization of osteoblasts in the endosteum at 400× magnification using sense and antisense probes.

Figure 13:
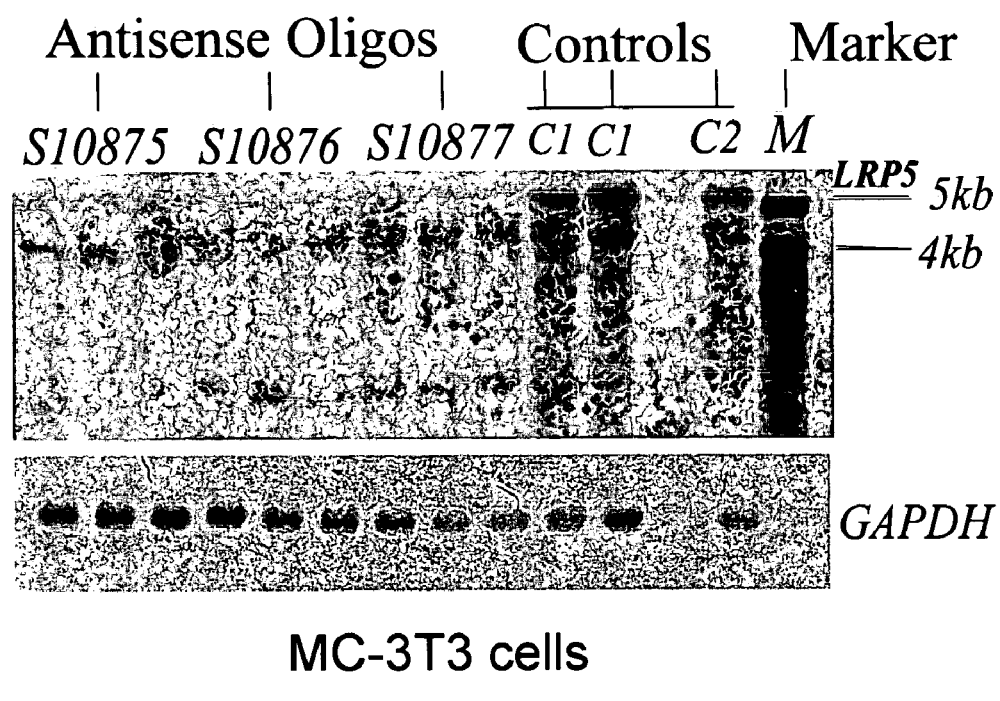

FIG. 13 shows antisense inhibition of LRP5 (Zmax1) expression in MC-3T3 cells.

FIGS. 14A and 14B show a LRP5 (Zmax1) Exon3 Allele Specific Oligonucleotide (ASO) assay which illustrates the rarity of the HBM allele (right panels; T-specific oligo; 58° C. Wash) as compared to the wild-type LRP5 allele (left panels, G-specific oligo; 55° C. Wash). The positive spots appearing in the right panels were positive controls.

Figure 15:
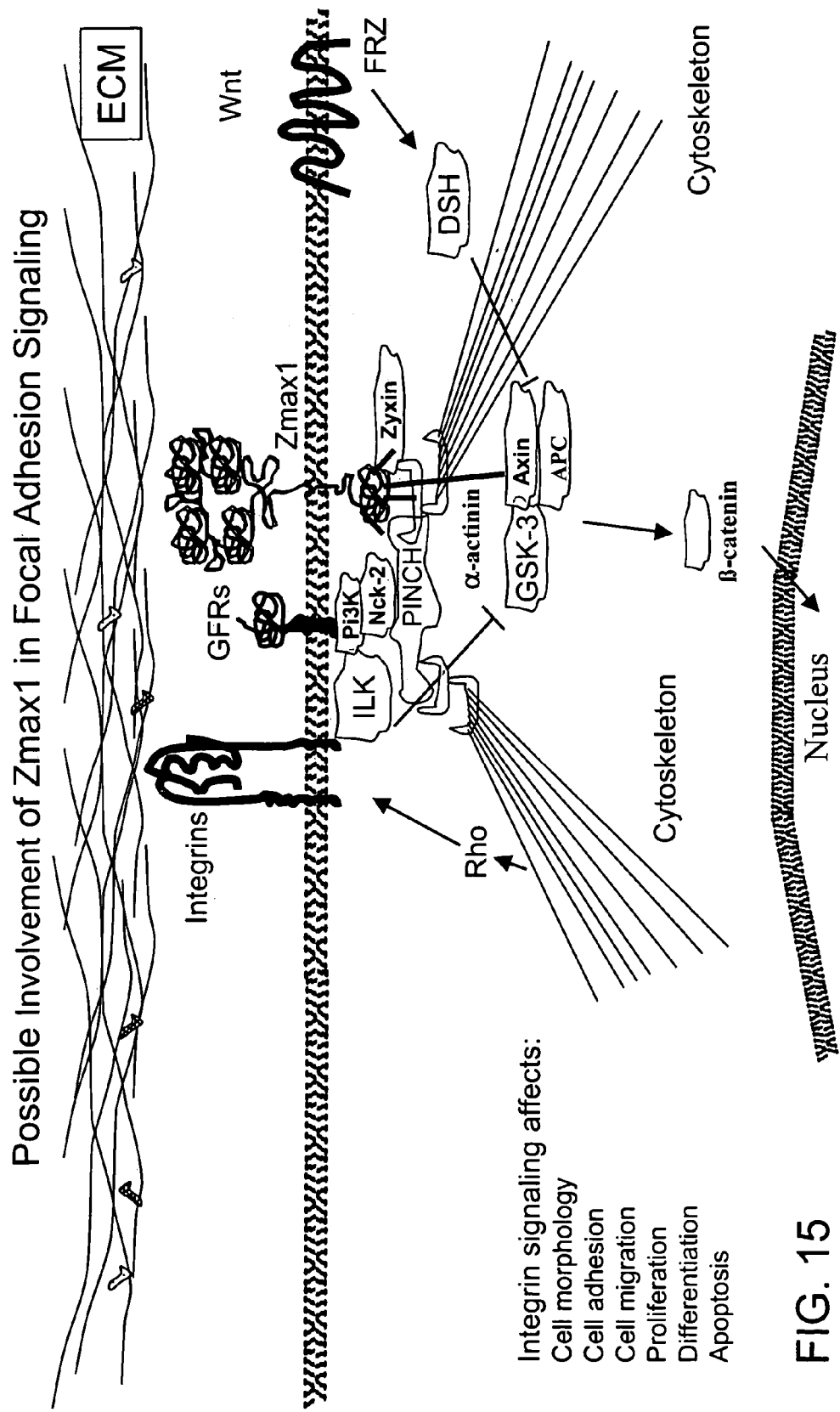

FIG. 15 depicts a model representing the potential role of LRP5 (Zmax1) in focal adhesion signaling.

Figure 16:
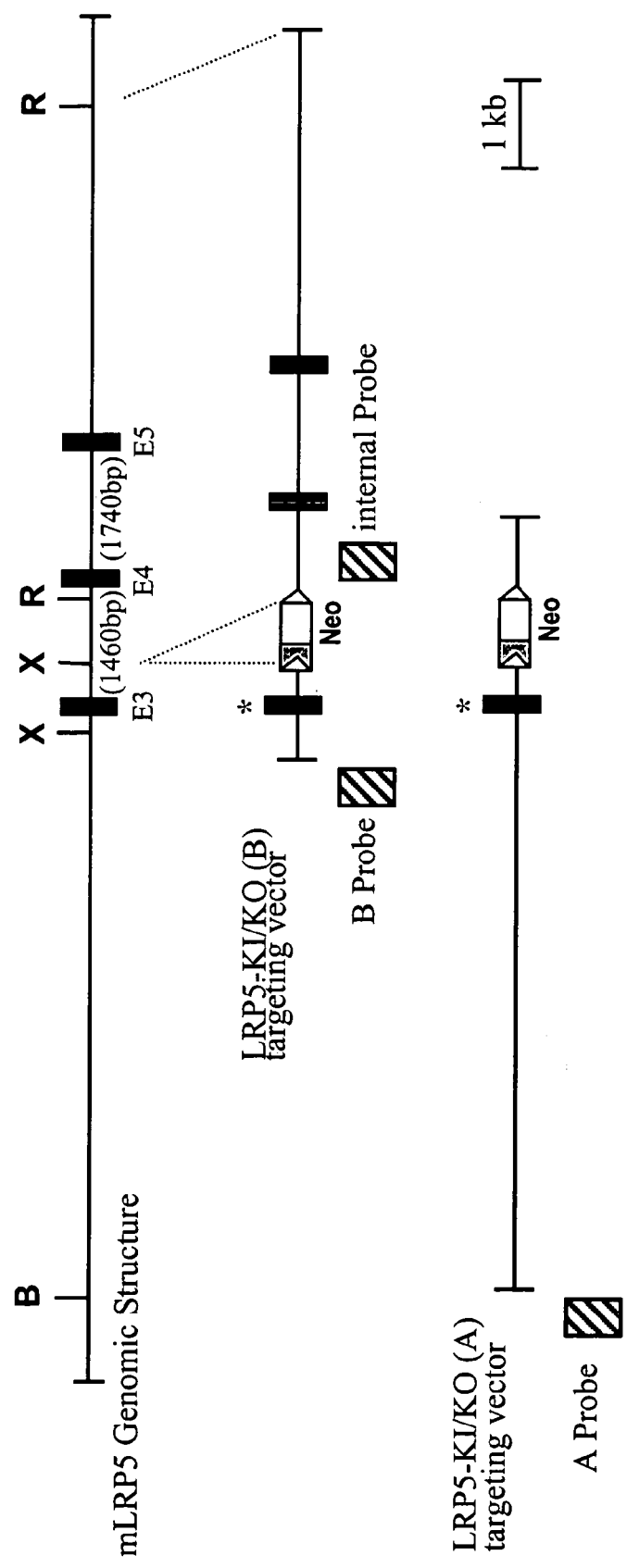

FIG. 16 depicts a schematic of two LRP5 (Zmax1) gene targeting vectors for the knock-out of endogenous mouse LRP5 or conditional knock-in of the HBM polymorphism. B, X, and R indicate BamHI, XbaI, and EcoRI sites in DNA BAC 4735P5 respectively. Exons 3, 4, and 5 are indicated by black rectangles. A G→T base change is engineered at base 24 of exon 3 to produce the HBM polymorphism. The location of a LoxP flanked cassette containing a neomycin resistance gene and a synthetic pause sequence and probes used for screening and characterizing of ES cell clones are also indicated.

FIG. 17 confirms expression by the transgenic (i.e., HBMMCBA and HBMMTIC) and wild-type (i.e., ZmaxWTCBA and ZmaxWTTIC) plasmid constructs. These constructs were transiently transfected into HOB-02-02 cells and the mRNA levels determined using TaqMan® quantitative PCR. HBMMCBA and ZmaxWTCBA are shown in the left column (i.e. CMVβActin) and HBMMTIC and ZmaxWTTIC are shown in the right column (i.e. Type I collagen) of the Table.

Figure 18:
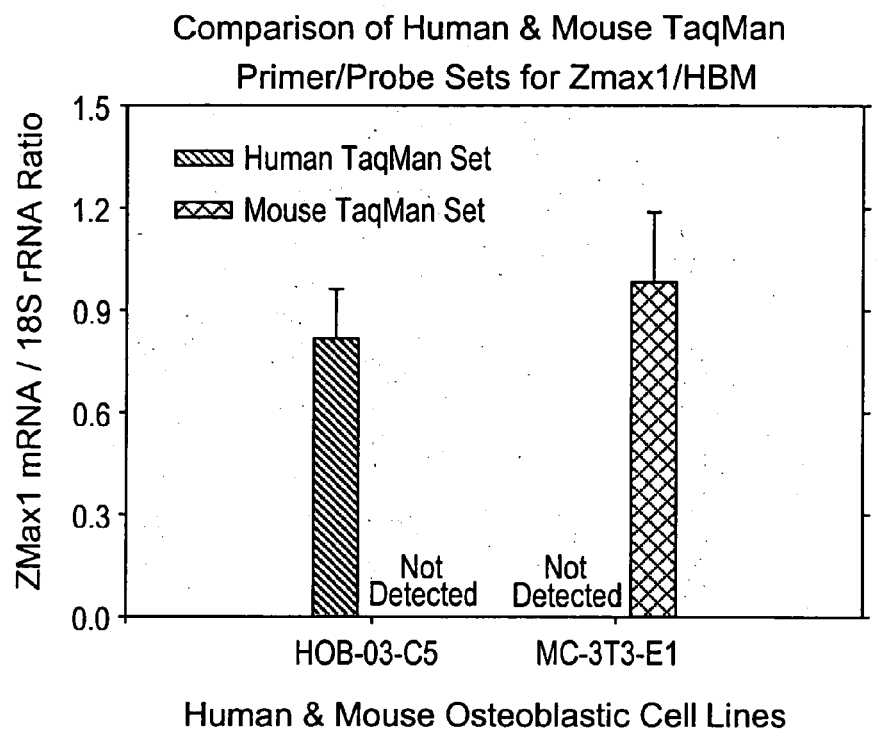

FIG. 18 depicts a comparison between the human and mouse TaqMan® Primer/Probe sets. HOB (HOB-03-C5) and mouse (MC-3T3-E1) osteoblastic cell mRNA was analyzed using the probes and primers.

Figure 19:
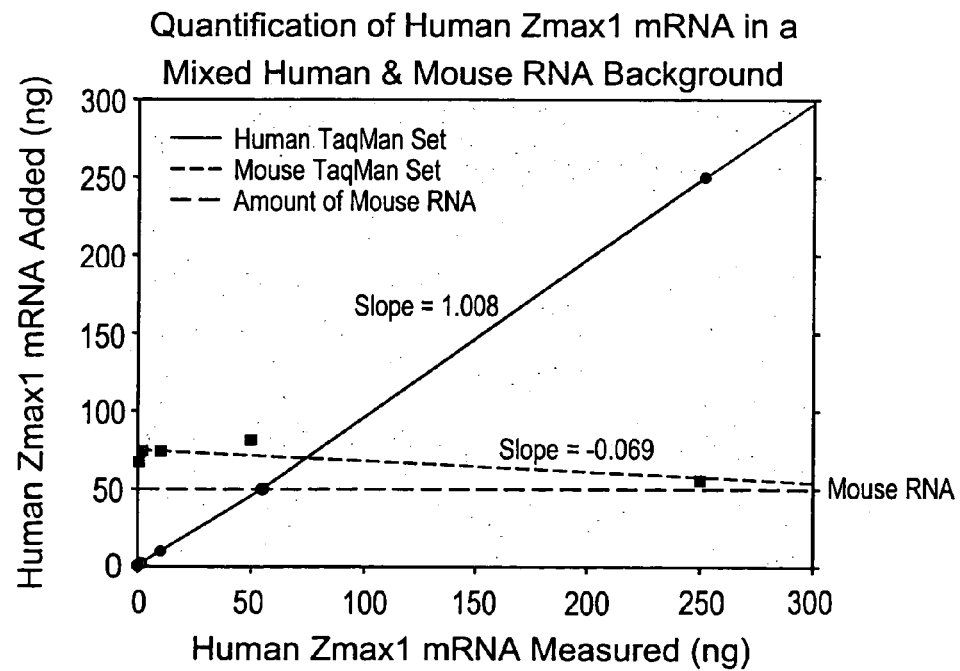

FIG. 19 depicts the quantification of human LRP5 (Zmax1) mRNA expressed in a mixed human and mouse RNA background using the TaqMan® Primer/Probe sets. Results are presented in Human LRP5 mRNA added (ng) versus Human LRP5 mRNA measured (ng).

Figures 20, 21A:
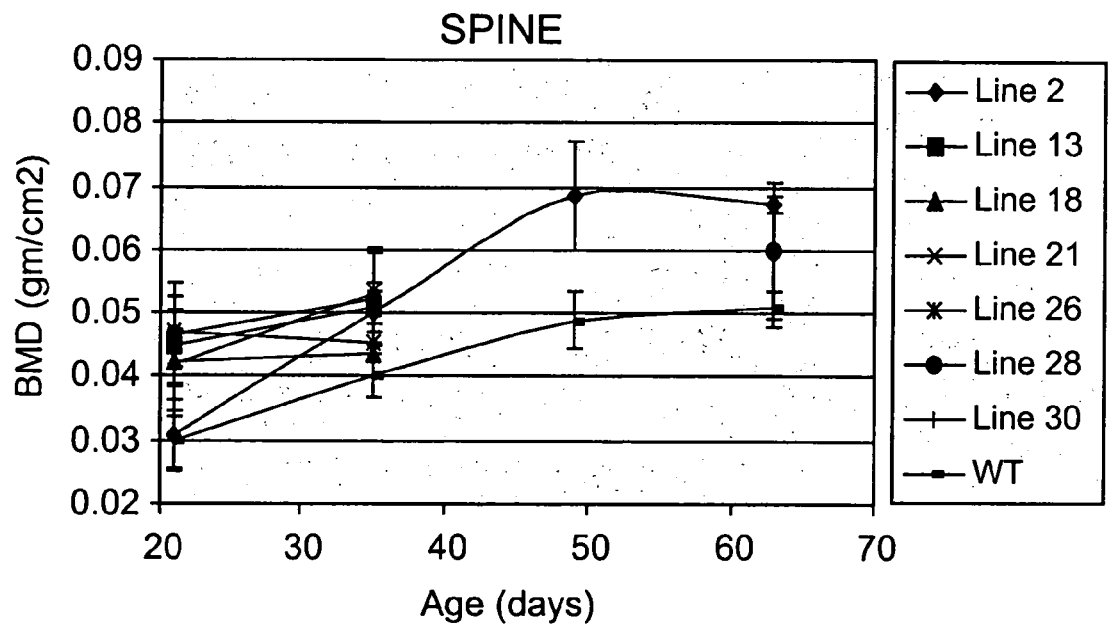

FIG. 20 depicts expression of HBM in transgenic mice based on mRNA expression analyzed by TaqMan®.

Figure 21B:
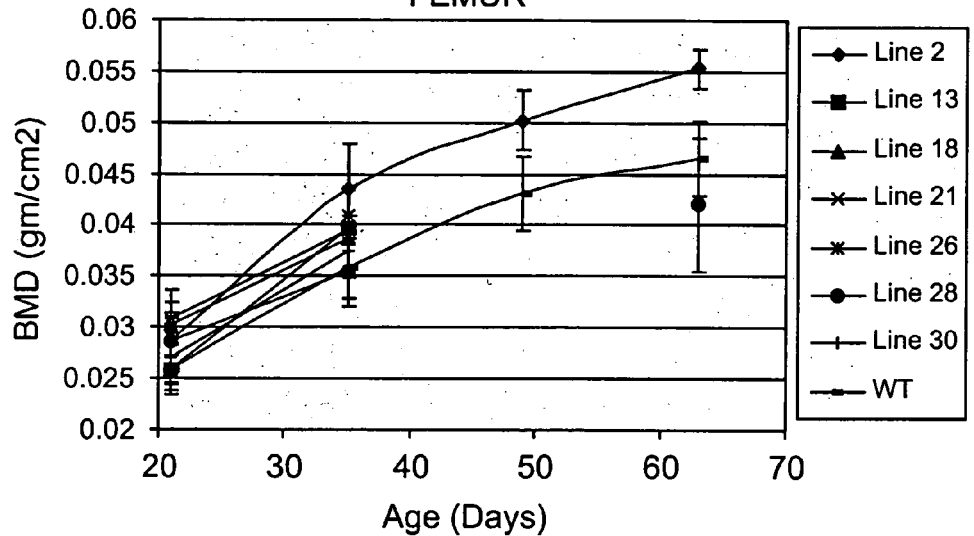
Figure 21C:
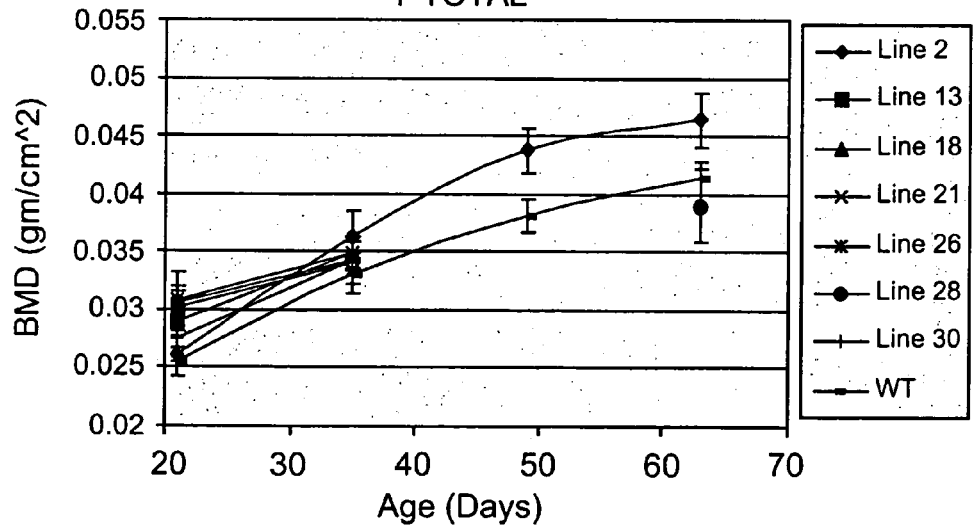
Figure 21D:
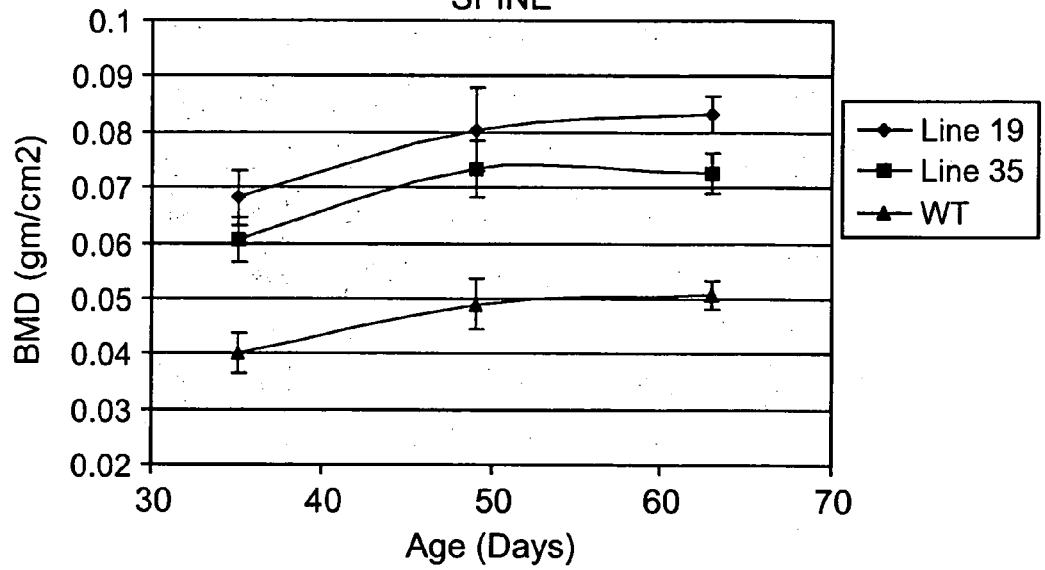
Figure 21E:
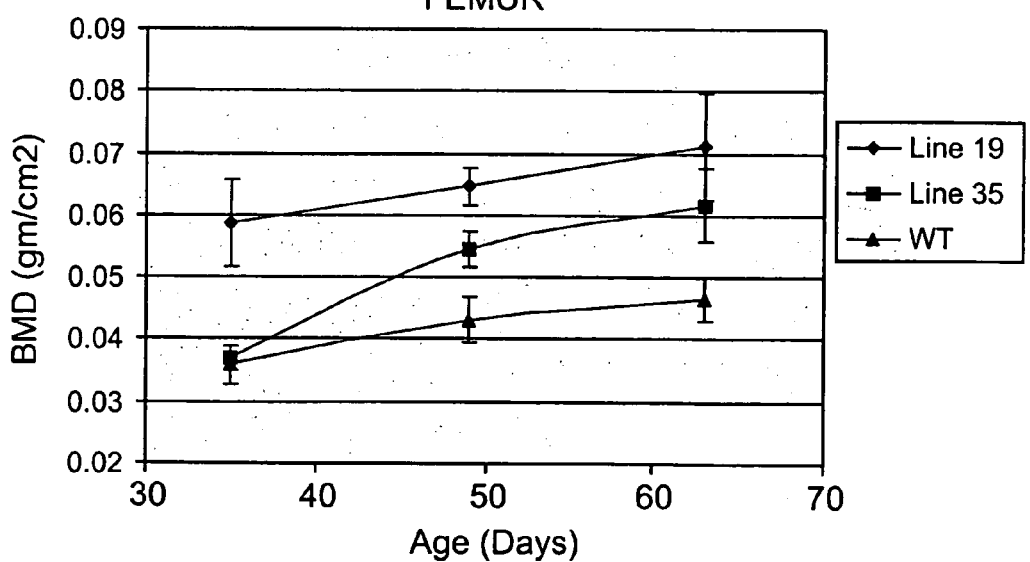

FIGS. 21(A-C) depict the analysis of various transgenic mouse lines that express the HBMMCBA construct in spine (FIG. 21A), femur (FIG. 21B) and total body (FIG. 21C).

Figure 21F:
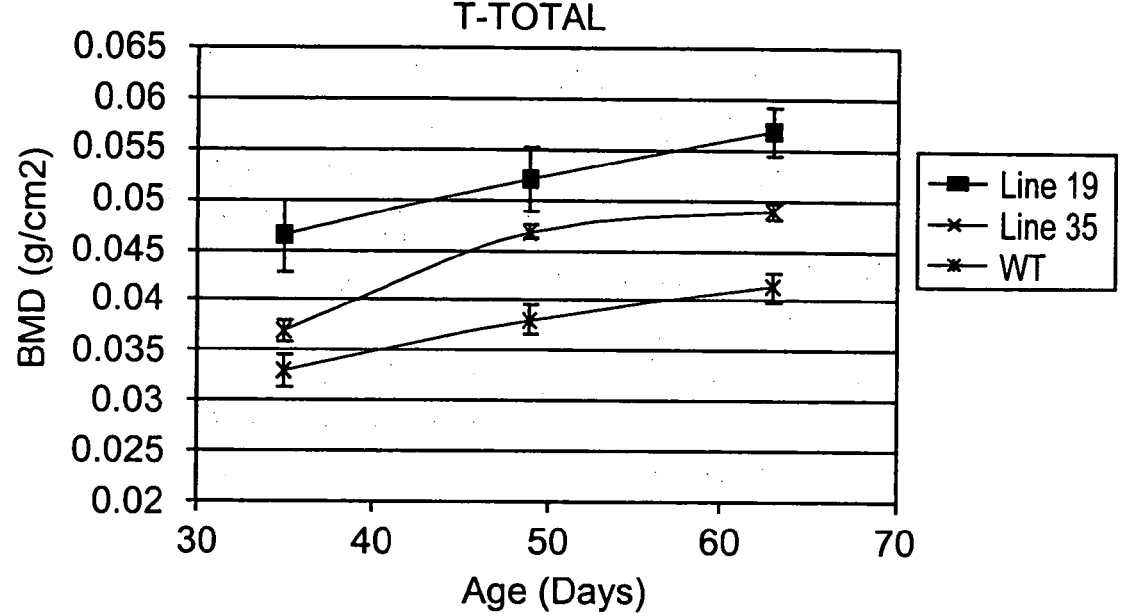
Figure 21G:
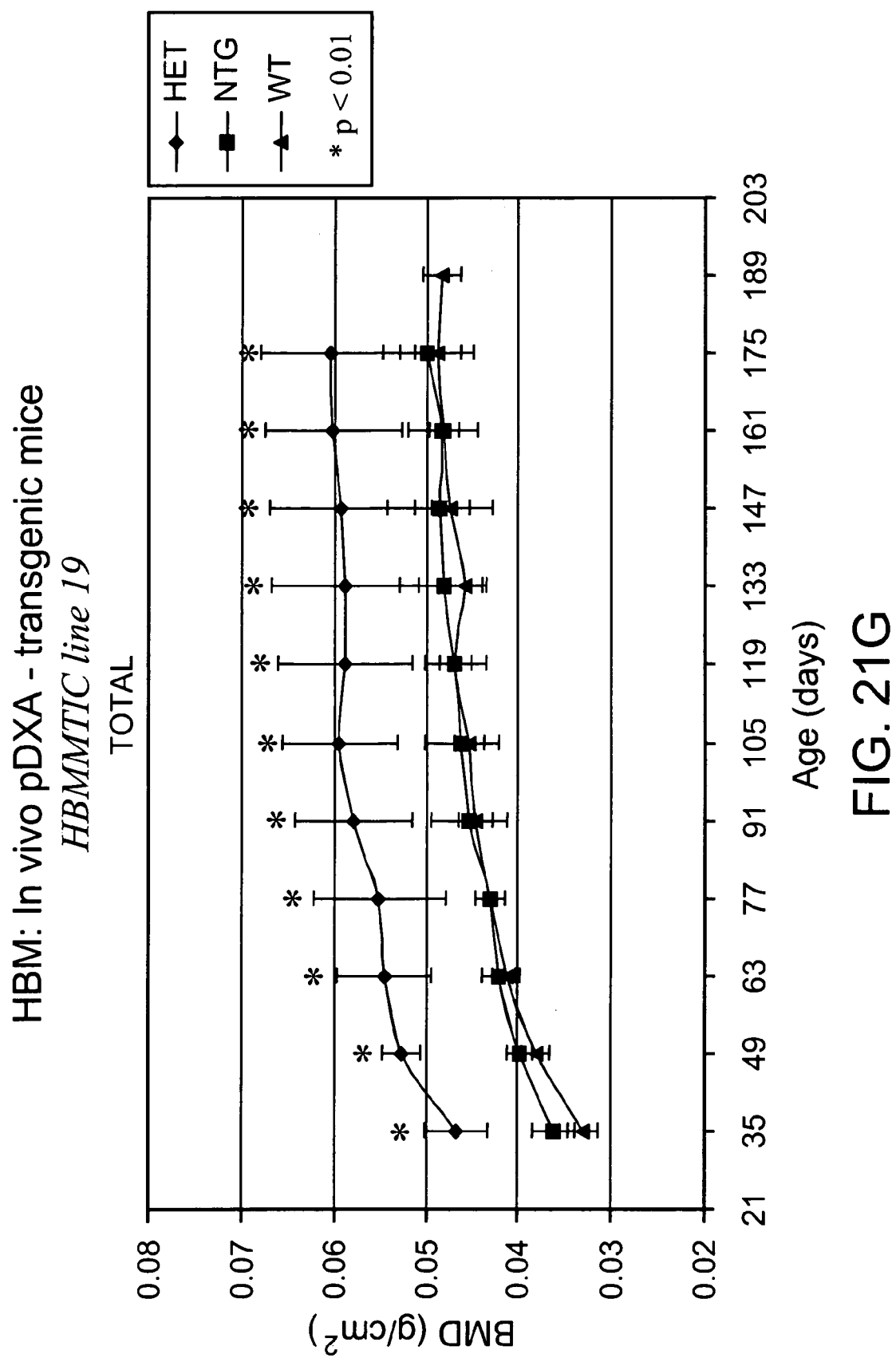
Figure 21H:
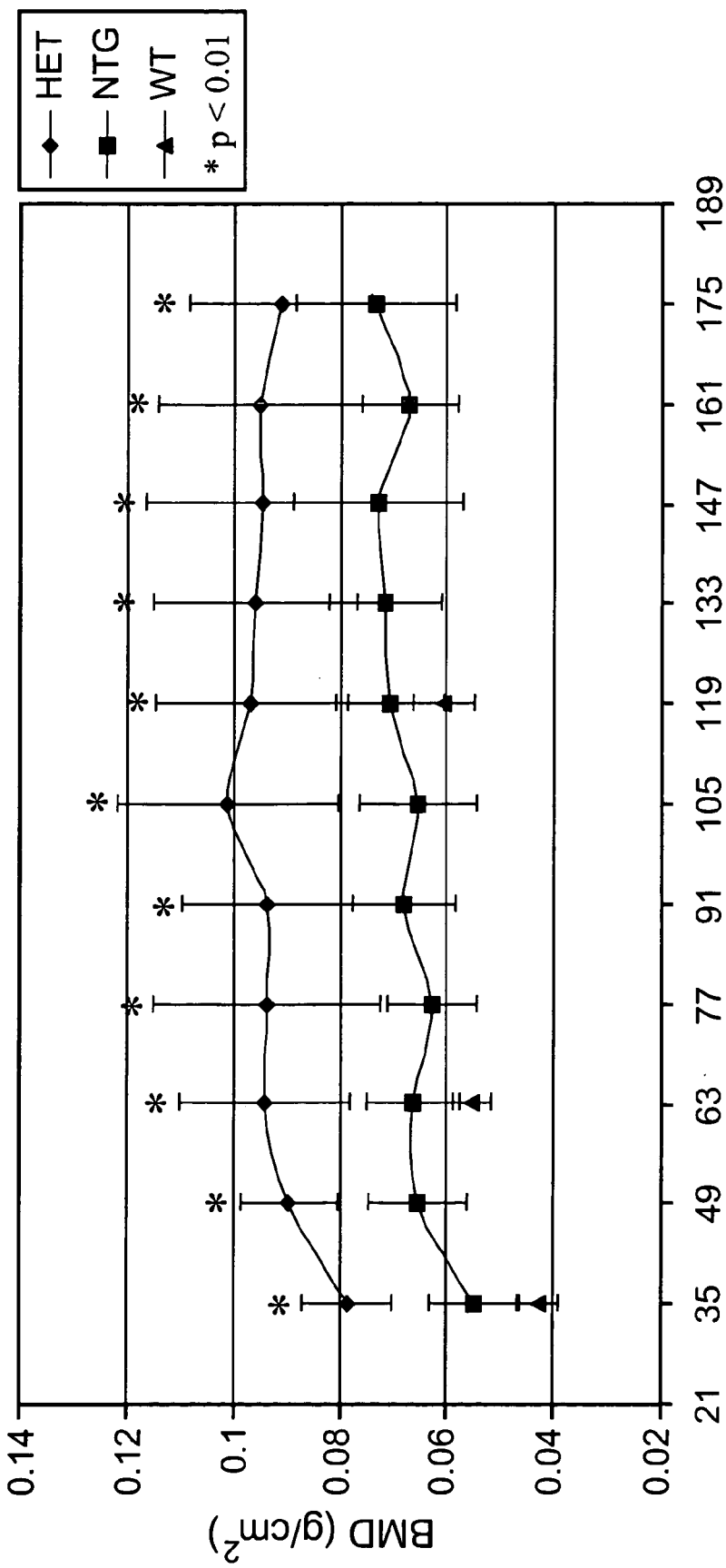
Figure 21I:
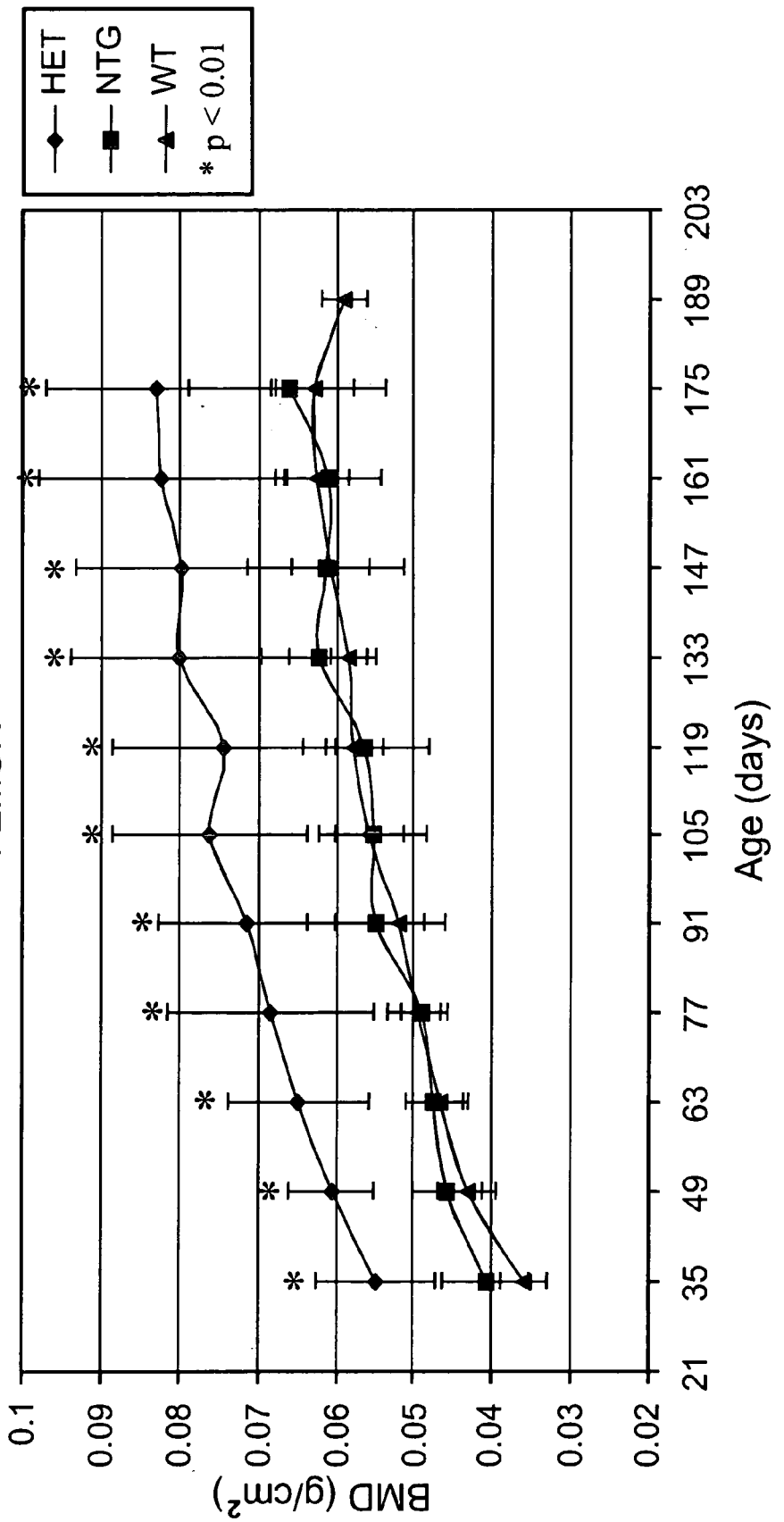
Figure 21J:
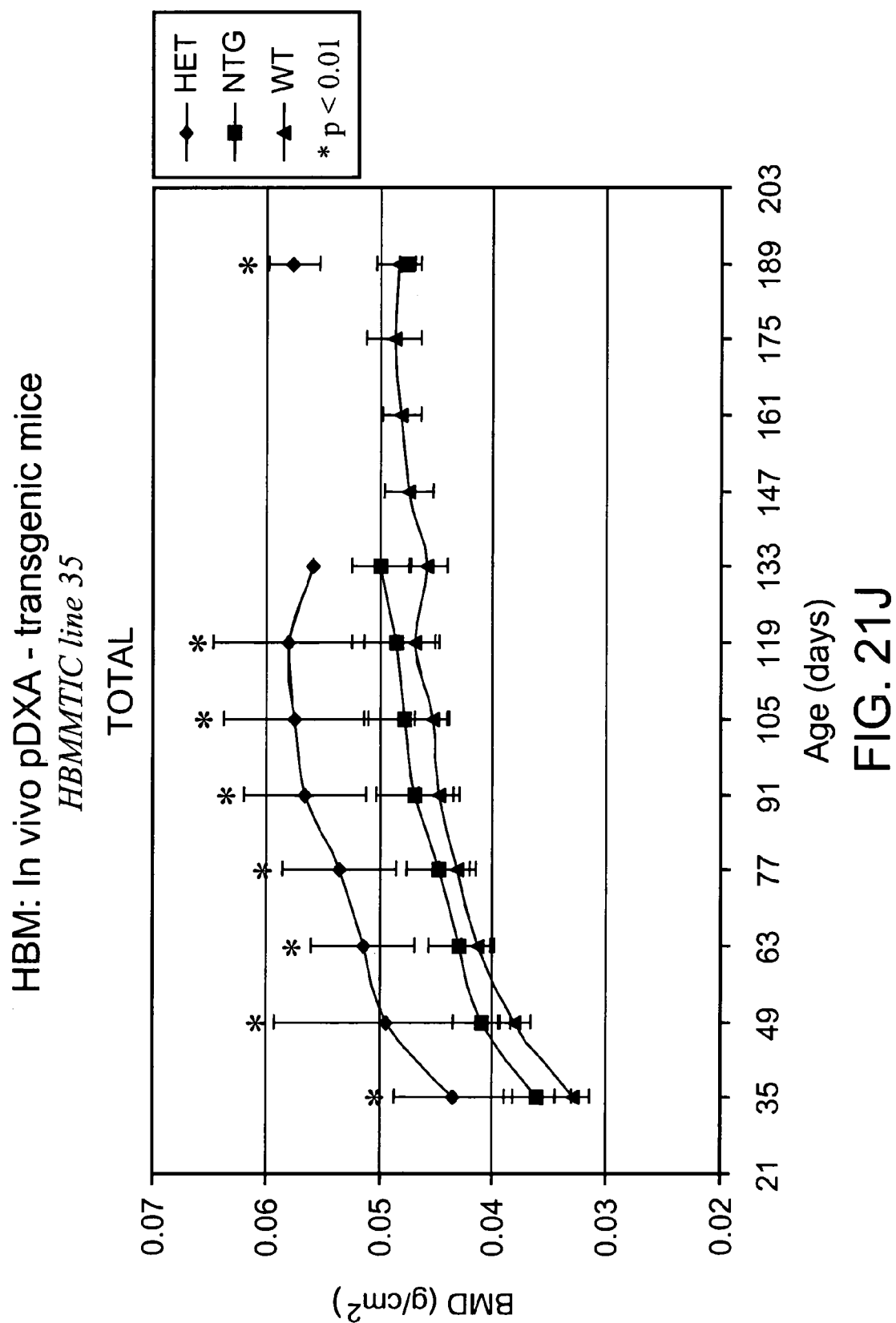
Figure 21L:
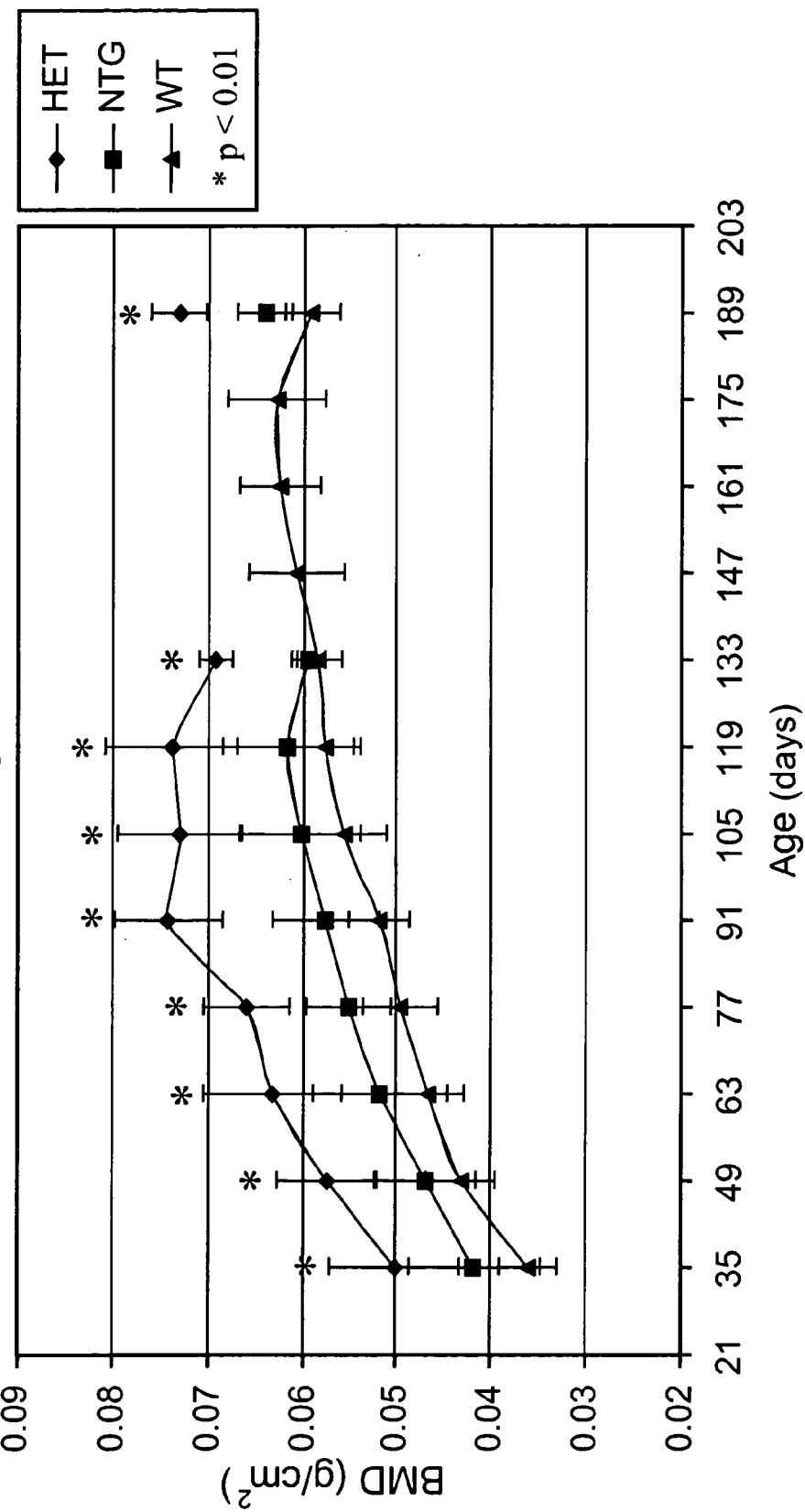

FIGS. 21(D-F) depict the analysis of various transgenic mouse lines that express the HBMMTIC construct in spine (FIG. 21D), femur (FIG. 21E) and total body (FIG. 21F).

FIGS. 21(G-L) depict the analysis of transgenic mouse lines that express the HBMMTIC construct (Lines 19 and 35) in spine, femur and total body through 17 weeks.

FIG. 22 depicts changes in BMD in HBM transgenic mice (i.e., HBMMCBA and HBMMTIC constructs) at 5 weeks using in vivo pDXA* analysis. The BMD changes are presented as compared to wild-type animals which were also only 5 weeks old.

FIG. 23 depicts changes in BMD in HBM transgenic mice (i.e., HBMMCBA and HBMMTIC constructs) at 9 weeks using in vivo pDXA* analysis. The BMD changes are presented as compared to wild-type animals which were also only 9 weeks old.

FIGS. 24(A-D) present the sequence of the HBMGI_2AS vector insert (SEQ ID NO: 759).

FIGS. 25(A-D) present the sequence of the ZMAXGI_3AS vector insert (SEQ ID NO: 760).

FIGS. 26(A-C) present an alignment of human (SEQ ID NO: 761) and mouse (SEQ ID NO: 762) LRP5 amino acid sequences.

FIGS. 27(A-C) present an alignment of human LRP5 (SEQ ID NO: 763) and LRP6 (SEQ ID NO: 764) amino acid sequences.

Figure 28:
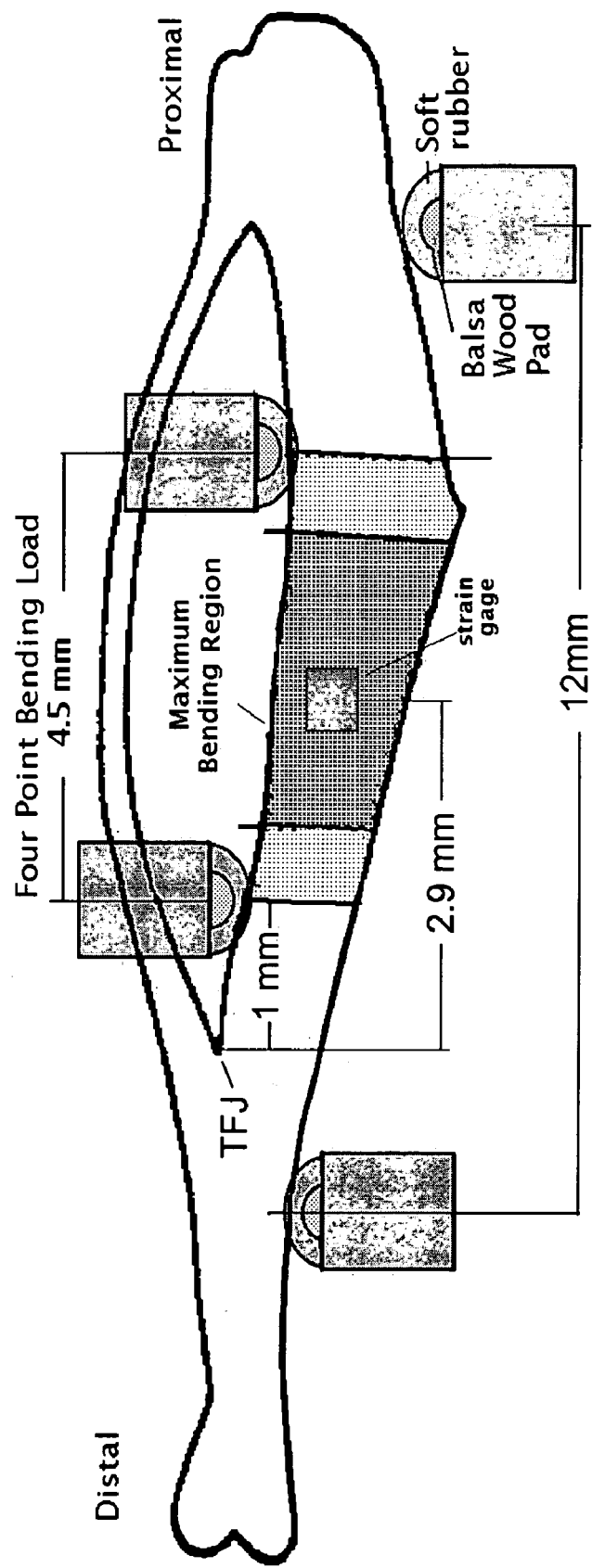

FIG. 28 illustrates an apparatus for testing the effects of loading on bone growth in a mouse.

Figure 29:
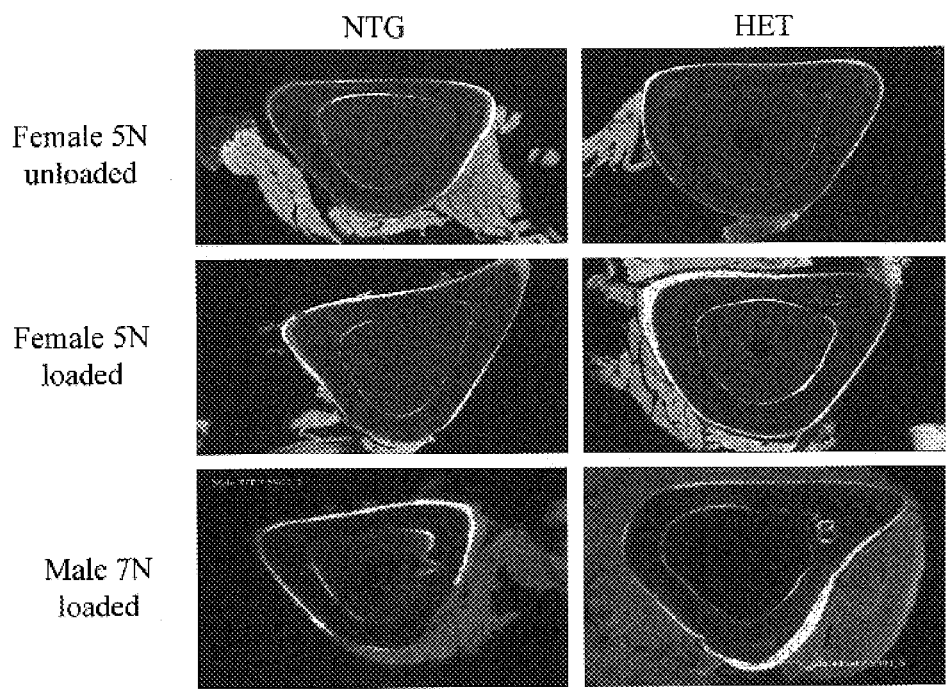

FIG. 29 presents a histological illustration of the effects of bone loading on bone growth in HBM transgenic and non-transgenic mice.

DETAILED DESCRIPTION OF THE INVENTION

To aid in the understanding of the specification and claims, the following definitions are provided.

"Gene" refers to a DNA sequence that encodes through its template or messenger RNA a sequence of amino acids characteristic of a specific peptide. The term "gene" includes intervening, non-coding regions, as well as regulatory regions, and can include 5' and 3' ends.

By "nucleic acid" is meant to include single stranded and double stranded nucleic acids, DNAs, RNAs (e.g., mRNA, tRNAs), cDNAs, recombinant DNA (rDNA), rRNAs, antisense nucleic acids, oligonucleotides, and oligomers, and polynucleotides. May also include hybrids such as triple stranded regions of RNA and/or DNA or double stranded RNA:DNA hybrids. And may include modified bases such as biotinylated, tritylated, fluorophor, inosine, and etc.

"Gene sequence" refers to a nucleic acid molecule, including DNA which contains a non-transcribed or non-translated sequence, which comprises a gene. The term is also intended to include any combination of gene(s), gene fragment(s), non-transcribed sequence(s) or non-translated sequence(s) which are present on the same DNA molecule.

The nucleic acid sequences of the present invention may be derived from a variety of sources including DNA, cDNA, synthetic DNA, synthetic RNA or combinations thereof. Such sequences may comprise genomic DNA which may or may not include naturally occurring introns. Moreover, such genomic DNA may be obtained in association with promoter regions and/or poly (A) sequences. The sequences, genomic DNA or cDNA may be obtained in any of several ways. Genomic DNA can be extracted and purified from suitable cells by means well known in the art. Alternatively, mRNA can be isolated from a cell and used to produce cDNA by reverse transcription or other means.

"cDNA" refers to complementary or copy DNA produced from an RNA template by the action of RNA-dependent DNA polymerase (reverse transcriptase). Thus, a "cDNA clone"

means a duplex DNA sequence for which one strand is complementary to an RNA molecule of interest, carried in a cloning vector or PCR amplified. cDNA can also be single stranded after first strand synthesis by reverse transcriptase. In this form it is a useful PCR template and does not need to be carried in a cloning vector. This term includes genes from which the intervening sequences have been removed. Thus, the term "gene", as sometimes used generically, can also include nucleic acid molecules comprising cDNA and cDNA clones.

"Recombinant DNA" means a molecule that has been engineered by splicing in vitro a cDNA or genomic DNA sequence or altering a sequence by methods such as PCR mutagenesis.

"Cloning" refers to the use of in vitro recombination techniques to insert a particular gene or other DNA sequence into a vector molecule. In order to successfully clone a desired gene, it is necessary to use methods for generating DNA fragments, for joining the fragments to vector molecules, for introducing the composite DNA molecule into a host cell in which it can replicate, and for selecting the clone having the target gene from amongst the recipient host cells.

"cDNA library" refers to a collection of recombinant DNA molecules containing cDNA inserts which together comprise the entire or a partial repertoire of genes expressed in a particular tissue or cell source. Such a cDNA library can be prepared by methods known to one skilled in the art and described by, for example, Cowell and Austin, "cDNA Library Protocols," Methods in Molecular Biology (1997).

"Cloning vehicle" refers to a plasmid or phage DNA or other DNA sequence which is able to replicate in a host cell. This term can also include artificial chromosomes such as BACs and YACs. The cloning vehicle is characterized by one or more endonuclease recognition sites at which such DNA sequences may be cut in a determinable fashion without loss of an essential biological function of the DNA, which may contain a marker suitable for use in the identification of transformed cells.

"Expression" refers to the process comprising transcription of a gene sequence and subsequent processing steps, such as translation of a resultant mRNA to produce the final end product of a gene. The end product may be a protein (such as an enzyme or receptor) or a nucleic acid (such as a tRNA, antisense RNA, or other regulatory factor). The term "expression control sequence" refers to a sequence of nucleotides that control or regulate expression of structural genes when operably linked to those genes. These include, for example, the lac systems, the trp system, major operator and promoter regions of the phage lambda, the control region of fd coat protein and other sequences known to control the expression of genes in prokaryotic or eukaryotic cells. Expression control sequences will vary depending on whether the vector is designed to express the operably linked gene in a prokaryotic or eukaryotic host, and may contain transcriptional elements such as enhancer elements, termination sequences, tissue-specificity elements and/or translational initiation and termination sites.

"Expression vehicle" refers to a vehicle or vector similar to a cloning vehicle but which is capable of expressing a gene which has been cloned into it, after transformation into a host. The cloned gene is usually placed under the control of (i.e., operably linked to) an expression control sequence.

"Operator" refers to a DNA sequence capable of interacting with the specific repressor, thereby controlling the transcription of adjacent gene(s).

"Promoter" refers to a DNA sequence that can be recognized by an RNA polymerase. The presence of such a sequence permits the RNA polymerase to bind and initiate transcription of operably linked gene sequences.

"Promoter region" is intended to include the promoter as well as other gene sequences which may be necessary for the initiation of transcription. The presence of a promoter region is sufficient to cause the expression of an operably linked gene sequence. The term "promoter" is sometimes used in the art to generically indicate a promoter region. Many different promoters are known in the art which direct expression of a gene in a certain cell types. Tissue-specific promoters can comprise nucleic acid sequences which cause a greater (or decreased) level of expression in cells of a certain tissue type.

"Operably linked" means that the promoter controls the initiation of expression of the gene. A promoter is operably linked to a sequence of proximal DNA if upon introduction into a host cell the promoter determines the transcription of the proximal DNA sequence(s) into one or more species of RNA. A promoter is operably linked to a DNA sequence if the promoter is capable of initiating transcription of that DNA sequence.

"Prokaryote" refers to all organisms without a true nucleus, including bacteria.

"Eukaryote" refers to organisms and cells that have a true nucleus, including mammalian cells.

"Host" includes prokaryotes and eukaryotes, such as yeast and filamentous fungi, as well as plant and animal cells. The term includes an organism or cell that is the recipient of a replicable expression vehicle.

The term "animal" is used herein to include all vertebrate animals, except humans (e.g., primates, canines, felines, rodents, ovines, bovines, and the like). It also includes an individual animal in all stages of development, including embryonic and fetal stages.

A "transgenic animal" is an animal containing one or more cells bearing genetic information received, directly or indirectly, by deliberate genetic manipulation or by inheritance from a manipulated progenitor at a subcellular level, such as by microinjection or infection with a recombinant viral vector (e.g., adenovirus, retrovirus, herpes virus, adeno-associated virus, lentivirus). This introduced DNA molecule may be integrated within a chromosome, or it may be extra-chromosomally replicating DNA.

"Embryonic stem cells" or "ES cells" as used herein are cells or cell lines usually derived from embryos which are pluripotent meaning that they are undifferentiated cells. These cells are also capable of incorporating exogenous DNA by homologous recombination and subsequently developing into any tissue in the body when incorporated into a host embryo. It is possible to isolate pluripotent cells from sources other than embryonic tissue by methods which are well understood in the art.

Embryonic stem cells in mice have enabled researchers to select for transgenic cells and perform gene targeting. This allows more genetic engineering than is possible with other transgenic techniques. For example, mouse ES cells are relatively easy to grow as colonies in vitro. The cells can be transfected by standard procedures and transgenic cells clonally selected by antibiotic resistance. See, for example, Doetschman et al., 1994, *Gene transfer in embryonic stem cells*. In Pinkert (Ed.) *Transgenic Animal Technology: A Laboratory Handbook*. Academic Press Inc., New York, pp. 115-146. Furthermore, the efficiency of this process is such that sufficient transgenic colonies (hundreds to thousands) can be produced to allow a second selection for homologous recombinants. Mouse ES cells can then be combined with a normal host embryo and, because they retain their potency, can develop into all the tissues in the resulting chimeric animal, including the germ cells. The transgenic modification can then be transmitted to subsequent generations.

Methods for deriving embryonic stem (ES) cell lines in vitro from early preimplantation mouse embryos are well known. See for example, Evans et al., 1981 *Nature* 29:154-156 and Martin, 1981, *Proc. Nat. Aca. Sci. USA*, 78:7634-7638. ES cells can be passaged in an undifferentiated state, provided that a feeder layer of fibroblast cells or a differentiation inhibiting source is present.

The term "somatic cell" indicates any animal or human cell which is not a sperm or egg cell or is capable of becoming a sperm or egg cell. The term "germ cell" or "germ-line cell" refers to any cell which is either a sperm or egg cell or is capable of developing into a sperm or egg cell and can therefore pass its genetic information to offspring. The term "germ cell-line transgenic animal" refers to a transgenic animal in which the genetic information was incorporated in a germ line cell, thereby conferring the ability to transfer the information to offspring. If such offspring in fact possess some or all of that information, then they, too, are transgenic animals.

The genetic alteration of genetic information may be foreign to the species of animal to which the recipient belongs, or foreign only to the particular individual recipient. In the last case, the altered or introduced gene may be expressed differently than the native gene.

"Fragment" of a gene refers to any portion of a gene sequence. A biologically active fragment refers to any portion of the gene that retains at least one biological activity of that gene.

"Biologically active" refers to those forms of proteins and polypeptides, including conservatively substituted variants, alleles of genes encoding a protein or polypeptide fragments of proteins which retain a biological and/or immunological activity of the wild-type protein or polypeptide. Preferably the activity is one which induces a change in bone mass development or phenotype. Biologically active also refers the capability to modulate a signaling pathway associated with LRP5 (Zmax1), LPR6, and HBM such as the Wnt pathway whether directly or indirectly and whether in vivo or in and in vitro assay.

By "effective amount" or "dose effective amount" or "therapeutically effective amount" is meant an amount of an agent which modulates a biological activity of the polypeptide of the invention.

"Variant" refers to a gene that is substantially similar in structure and biological activity or immunological characteristics to either the entire gene or to a fragment of the gene. Provided that the two genes possess a similar activity, they are considered variant as that term is used herein even if the sequence of encoded amino acid residues is not identical.

"Amplification of nucleic acids" refers to methods such as polymerase chain reaction (PCR), ligation amplification (or ligase chain reaction, LCR) and amplification methods based on the use of Q-beta replicase. These methods are well known in the art and described, for example, in U.S. Pat. Nos. 4,683,195 and 4,683,202. Reagents and hardware for conducting PCR are commercially available. Primers useful for amplifying sequences from the HBM region are preferably complementary to, and hybridize specifically to sequences in the HBM region or in regions that flank a target region therein. HBM sequences generated by amplification may be sequenced directly. Alternatively, the amplified sequence(s) may be cloned prior to sequence analysis.

"Antibody" is meant to include but not limited to polyclonal, monoclonal, chimeric, human, humanized, bispecific, multispecific, primatized™ antibodies. The term "antibodies" preferably refers to polyclonal and/or monoclonal antibodies and fragments thereof, and immunologic binding equivalents thereof, that can bind to the HBM proteins and fragments thereof or to nucleic acid sequences from the HBM region, particularly from the HBM locus or a portion thereof. The term antibody is used both to refer to a homogeneous molecular entity, or a mixture such as a serum product made up of a plurality of different molecular entities. Proteins may be prepared synthetically in a protein synthesizer and coupled to a carrier molecule and injected over several months into rabbits. Rabbit sera is tested for immunoreactivity to the HBM protein or fragment. Monoclonal antibodies may be made by injecting mice with the proteins, or fragments thereof. Monoclonal antibodies will be screened by ELISA and tested for specific immunoreactivity with HBM protein or fragments thereof. Harlow et al., *Antibodies: A Laboratory Manual*, Cold Spring Harbor Laboratory, Cold Spring Harbor, N.Y. (1988). These antibodies will be useful in assays as well as pharmaceuticals.

The LRP5 gene and the LRP5 protein which it encodes have previously been referred to as Zimax1 and Zmax1 by the inventors. The gene and its product have also been referred to in the art with the designation LR3. It is understood that Zmax, Zmax1, LRP5, and LR3 are synonymous terms. "HBM protein" refers to a protein that is identical to a LRP5 protein except that it contains an alteration of glycine 171 to valine. An HBM protein is defined for any organism that encodes a LRP5 true homolog. For example, a mouse HBM protein refers to the mouse LRP5 protein having the glycine 170 to valine substitution. HBM can also be referred to as HBM1.

In one embodiment of the present invention, "HBM gene" refers to the genomic DNA sequence found in individuals showing the HBM characteristic or phenotype, where the sequence encodes the protein indicated by SEQ ID NO: 4. The HBM gene and the LRP5 gene are allelic. The protein encoded by the HBM gene has the property of causing elevated bone mass, while the protein encoded by the LRP5 gene does not. The HBM gene and the LRP5 gene differ in that the HBM gene has a thymine at position 582, while the LRP5 gene has a guanine at position 582. The HBM gene comprises the nucleic acid sequence shown as SEQ ID NO: 2. The HBM gene may also be referred to as an "HBM polymorphism."

In alternative embodiments of the present invention, "HBM gene" may also refer to any allelic variant of LRP5 (Zmax1) or LRP6 which results in the HBM phenotype. Such variants may include alteration from the wild-type protein coding sequence as described herein and/or alteration in expression control sequences of LRP5. A preferred example of such a variant is an alteration of the endogenous LRP5 promoter region resulting in increased expression of the LRP5 protein.

"Normal," "wild-type," "unaffected" and "LRP5" all refer to the genomic DNA sequence that encodes the protein indicated by SEQ ID NO: 3. The LRP5 gene has a guanine at position 582. The LRP5 (Zmax1) gene comprises the nucleic acid sequence shown as SEQ ID NO: 1. "Normal," "wild-type," "unaffected" and "LRP5 " also refer to allelic variants of the genomic sequence that encodes proteins that do not contribute to elevated bone mass. The LRP5 gene is common in the human population, while the HBM gene is rare.

"5YWTD+EGF" refers to a repeat unit found in the LRP5 protein, consisting of five YWTD repeats followed by an EGF repeat.

"Bone development" generally refers to any process involved in the change of bone over time, including, for example, normal development, changes that occur during disease states, and changes that occur during aging. This may refer to structural changes in and dynamic rate changes such as growth rates, resorption rates, bone repair rates, and etc. "Bone development disorder" particularly refers to any disorders in bone development including, for example, changes that occur during disease states and changes that occur during aging. Bone development may be progressive or cyclical in nature. Aspects of bone that may change during development include, for example, mineralization, formation of specific anatomical features, and relative or absolute numbers of various cell types.

"Bone modulation" or "modulation of bone formation" refers to the ability to affect any of the physiological processes involved in bone remodeling, as will be appreciated by one skilled in the art, including, for example, bone resorption and appositional bone growth, by, inter alia, osteoclastic and osteoblastic activity, and may comprise some or all of bone formation and development as used herein.

Bone is a dynamic tissue that is continually adapting and renewing itself through the removal of old or unnecessary bone by osteoclasts and the rebuilding of new bone by osteoblasts. The nature of the coupling between these processes is responsible both for the modeling of bone during growth as well as the maintenance of adult skeletal integrity through remodeling and repair to meet the everyday needs of mechanical usage. There are a number of diseases of bone that result from an uncoupling of the balance between bone resorption and formation. With aging there is a gradual "physiologic" imbalance in bone turnover, which is particularly exacerbated in women due to menopausal loss of estrogen support, that leads to a progressive loss of bone. The reduction in bone mass and deterioration in bone architecture results in an increase in bone fragility and susceptibility to spontaneous fractures. For every 10 percent of bone that is lost the risk of fracture doubles. Individuals with bone mineral density (BMD) in the spine or proximal femur 2.5 or more standard deviations below normal peak bone mass are classified as osteoporotic. However, osteopenic individuals with BMD between 1 and 2.5 standard deviations below the norm are clearly at risk of suffering bone loss related disorders.

Bone modulation may be assessed by measuring parameters such as bone mineral density (BMD) and bone mineral content (BMC) by pDXA X-ray methods, bone size, thickness or volume as measured by X-ray, bone formation rates as measured for example by calcien labeling, total, trabecular, and mid-shaft density as measured by pQCT and/or µCT methods, connectivity and other histological parameters as measured by µCT methods, mechanical bending and compressive strengths as preferably measured in femur and vertebrae respectively. Due to the nature of these measurements, each may be more or less appropriate for a given situation as the skilled practitioner will appreciate. Furthermore, parameters and methodologies such as a clinical history of freedom from fracture, bone shape, bone morphology, connectivity, normal histology, fracture repair rates, and other bone quality parameters are known and used in the art. Most preferably, bone quality may be assessed by the compressive strength of vertebra when such a measurement is appropriate. Bone modulation may also be assessed by rates of change in the various parameters. Most preferably, bone modulation is assessed at more than one age.

"Normal bone density" refers to a bone density within two standard deviations of a Z score of 0 in the context of the HBM linkage study. In a general context, the range of normal bone density parameters is determined by routine statistical methods. A normal parameter is within about 1 or 2 standard deviations of the age and sex normalized parameter, preferably about 2 standard deviations. A statistical measure of meaningfulness is the P value which can represent the likelihood that the associated measurement is significantly different from the mean. Significant P values are P<0.05, 0.01, 0.005, and 0.001, preferably at least P<0.01.

"HBM" refers to high bone mass although this term may also be expressed in terms of bone density, mineral content, and size.

The "HBM phenotype" may be characterized by an increase of about 2 or more standard deviations, preferably 2, 2.5, 3, or more standard deviations in 1, 2, 3, 4, 5, or more quantitative parameters of bone modulation, preferably bone density and mineral content and bone strength parameters, above the age and sex norm for that parameter. The HBM phenotype is characterized by statistically significant increases in at least one parameter, preferably at least 2 parameters, and more preferably at least 3 or more parameters. The HBM phenotype may also be characterized by an increase in one or more bone quality parameters and most preferably increasing parameters are not accompanied by a decrease in any bone quality parameters. Most preferably, an increase in bone modulation parameters and/or bone quality measurements is observed at more than one age.

A "LRP5 system" refers to a purified protein, cell extract, cell, animal, human or any other composition of matter in which LRP5 is present in a normal or mutant form.

The term "isolated" refers to a substance altered by hand of man from the natural environment. An isolated peptide may be for example in a substantially pure form or otherwise displaced from its native environment such as by expression in an isolated cell line or transgenic animal. An isolated sequence may for example be a molecule in substantially pure form or displaced from its native environment such that at least one end of said isolated sequence is not contiguous with the sequence it would be contiguous with in nature.

A "surrogate marker" refers to a diagnostic indication, symptom, sign or other feature that can be observed in a cell, tissue, human or animal that is correlated with the HBM gene or elevated bone mass or both, but that is easier to measure than bone density. The general concept of a surrogate marker is well accepted in diagnostic medicine.

The present invention encompasses the LRP5 gene and LRP5 protein in the forms indicated by SEQ ID NOS: 1 and 3, respectively, and other closely related variants, as well as the adjacent chromosomal regions of LRP5 necessary for its accurate expression. In a preferred embodiment, the present invention is directed to at least 15 contiguous nucleotides of the nucleic acid sequence of SEQ ID NO: 1.

I. Introduction

The present invention also encompasses the HBM gene and HBM protein in the forms indicated by SEQ ID NO: 2 and 4, respectively, and other closely related variants, as well as the adjacent chromosomal regions of the HBM gene necessary for its accurate expression. In a preferred embodiment, the present invention is directed to at least 15 contiguous nucleotides of the nucleic acid sequence of SEQ ID NO: 2. More preferably, the present invention is directed to at least 15 contiguous nucleotides of the nucleic acid sequence of SEQ ID NO: 2, wherein one of the 15 contiguous nucleotides is the thymine at nucleotide 582.

The invention also relates to the nucleotide sequence of the LRP5 gene region, as well as the nucleotide sequence of the HBM region. More particularly, a preferred embodiment are the BAC clones containing segments of the LRP5 gene region B200E21-H and B527D12-H. A preferred embodiment is the nucleotide sequence of the BAC clones consisting of SEQ ID NOS: 5-12.

The invention also concerns the use of the nucleotide sequence to identify DNA probes for the LRP5 gene and the HBM gene, PCR primers to amplify the LRP5 gene and the HBM gene, nucleotide polymorphisms in the LRP5 gene and the HBM gene, and regulatory elements of the LRP5 gene and the HBM gene.

This invention describes the further localization of the chromosomal location of the LRP5 gene and HBM gene on chromosome 11q13.3 between genetic markers D11S987 and SNP_CONTIG033-6, as well as the DNA sequences of the LRP5 gene and the HBM gene. The chromosomal location was refined by the addition of more genetic markers to the mapping panel used to map the gene, and by the extension of the pedigree to include more individuals. The pedigree extension was critical because the new individuals that have been genotyped harbor critical recombination events that narrow the region. To identify genes in the region on 11q13.3, a set of BAC clones containing this chromosomal region was identified. The BAC clones served as a template for genomic DNA sequencing, and also as a reagent for identifying coding sequences by direct cDNA selection. Genomic sequencing and direct cDNA selection were used to characterize more than 1.5 million base pairs of DNA from 11q13.3. The LRP5 gene was identified within this region and the HBM gene was then discovered after mutational analysis of affected and unaffected individuals.

When a gene has been genetically localized to a specific chromosomal region, the genes in this region can be characterized at the molecular level by a series of steps that include: cloning of the entire region of DNA in a set of overlapping clones (physical mapping), characterization of genes encoded by these clones by a combination of direct cDNA selection, exon trapping and DNA sequencing (gene identification), and identification of mutations in these genes by comparative DNA sequencing of affected and unaffected members of the HBM kindred (mutation analysis).

Physical mapping is accomplished by screening libraries of human DNA cloned in vectors that are propagated in *E. coli* or *S. cereviseae* using PCR assays designed to amplify unique molecular landmarks in the chromosomal region of interest. To generate a physical map of the HBM candidate region, a library of human DNA cloned in Bacterial Artificial Chromosomes (BACs) was screened with a set of Sequence Tagged Site (STS) markers that had been previously mapped to chromosome 11q12-q13 by the efforts of the Human Genome Project.

STSs are unique molecular landmarks in the human genome that can be assayed by PCR. Through the combined efforts of the Human Genome Project, the location of thousands of STSs on the twenty-two autosomes and two sex chromosomes has been determined. For a positional cloning effort, the physical map is tied to the genetic map because the markers used for genetic mapping can also be used as STSs for physical mapping. By screening a BAC library with a combination of STSs derived from genetic markers, genes, and random DNA fragments, a physical map comprised of overlapping clones representing all of the DNA in a chromosomal region of interest can be assembled.

BACs are cloning vectors for large (80 kilobase to 200 kilobase) segments of human or other DNA that are propagated in *E. coli*. To construct a physical map using BACs, a library of BAC clones is screened so that individual clones harboring the DNA sequence corresponding to a given STS or set of STSs are identified. Throughout most of the human genome, the STS markers are spaced approximately 20 to 50 kilobases apart, so that an individual BAC clone typically contains at least two STS markers. In addition, the BAC libraries that were screened contain enough cloned DNA to cover the human genome six times over. Therefore, an individual STS typically identifies more than one BAC clone. By screening a six-fold coverage BAC library with a series of STS markers spaced approximately 50 kilobases apart, a physical map consisting of a series of overlapping BAC clones, i.e. BAC contigs, can be assembled for any region of the human genome. This map is closely tied to the genetic map because many of the STS markers used to prepare the physical map are also genetic markers.

When constructing a physical map, it often happens that there are gaps in the STS map of the genome that result in the inability to identify BAC clones that are overlapping in a given location. Typically, the physical map is first constructed from a set of STSs that have been identified through the publicly available literature and World Wide Web resources. The initial map consists of several separate BAC contigs that are separated by gaps of unknown molecular distance. To identify BAC clones that fill these gaps, it is necessary to develop new STS markers from the ends of the clones on either side of the gap. This is done by sequencing the terminal 200 to 300 base pairs of the BACs flanking the gap, and developing a PCR assay to amplify a sequence of 100 or more base pairs. If the terminal sequences are demonstrated to be unique within the human genome, then the new STS can be used to screen the BAC library to identify additional BACs that contain the DNA from the gap in the physical map. To assemble a BAC contig that covers a region the size of the HBM candidate region (2,000,000 or more base pairs), it is often necessary to develop new STS markers from the ends of several clones.

After building a BAC contig, this set of overlapping clones serves as a template for identifying the genes encoded in the chromosomal region. Gene identification can be accomplished by many methods. Three methods are commonly used: (1) a set of BACs selected from the BAC contig to represent the entire chromosomal region can be sequenced, and computational methods can be used to identify all of the genes, (2) the BACs from the BAC contig can be used as a reagent to clone cDNAs corresponding to the genes encoded in the region by a method termed direct cDNA selection, or (3) the BACs from the BAC contig can be used to identify coding sequences by selecting for specific DNA sequence motifs in a procedure called exon trapping. The present invention includes genes identified by the first two methods.

To sequence the entire BAC contig representing the HBM candidate region, a set of BACs was chosen for subcloning into plasmid vectors and subsequent DNA sequencing of these subclones. Since the DNA cloned in the BACs represents genomic DNA, this sequencing is referred to as genomic sequencing to distinguish it from cDNA sequencing. To initiate the genomic sequencing for a chromosomal region of interest, several non-overlapping BAC clones are chosen. DNA for each BAC clone is prepared, and the clones are sheared into random small fragments which are subsequently cloned into standard plasmid vectors such as pUC18. The plasmid clones are then grown to propagate the smaller fragments, and these are the templates for sequencing. To ensure adequate coverage and sequence quality for the BAC DNA sequence, sufficient plasmid clones are sequenced to yield six-fold coverage of the BAC clone. For example, if the BAC is 100 kilobases long, then phagemids are sequenced to yield 600 kilobases of sequence. Since the BAC DNA was randomly sheared prior to cloning in the phagemid vector, the 600 kilobases of raw DNA sequence can be assembled by computational methods into overlapping DNA sequences termed sequence contigs. For the purposes of initial gene identification by computational methods, six-fold coverage of each BAC is sufficient to yield ten to twenty sequence contigs of 1000 base pairs to 20,000 base pairs.

The sequencing strategy employed in this invention was to initially sequence "seed" BACs from the BAC contig in the HBM candidate region. The sequence of the "seed" BACs was then used to identify minimally overlapping BACs from the contig, and these were subsequently sequenced. In this manner, the entire candidate region was sequenced, with several small sequence gaps left in each BAC. This sequence served as the template for computational gene identification. One method for computational gene identification is to compare the sequence of BAC contig to publicly available databases of cDNA and genomic sequences, e.g. unigene, dbEST, genbank. These comparisons are typically done using the BLAST family of computer algorithms and programs (Altschul et al., *J. Mol. Biol.*, 215:403-410 (1990)). The BAC sequence can also be translated into protein sequence, and the protein sequence can be used to search publicly available protein databases, using a version of BLAST designed to analyze protein sequences (Altschul et al., *Nucl. Acids Res.*, 25:3389-3402 (1997)). Another method is to use computer algorithms such as MZEF (Zhang, *Proc. Natl. Acad. Sci.*, 94:565-568 (1997)) and GRAIL (Uberbacher et al., *Methods Enzymol.*, 266:259-281 (1996)), which predict the location of exons in the sequence based on the presence of specific DNA sequence motifs that are common to all exons, as well as the presence of codon usage typical of human protein encoding sequences.

In addition to identifying genes by computational methods, genes were also identified by direct cDNA selection (Del Mastro et al., *Genome Res.* 5(2):185-194 (1995)). In direct cDNA selection, cDNA pools from tissues of interest are prepared, and the BACs from the candidate region are used in a liquid hybridization assay to capture cDNA which basepairs to coding regions in the BAC. In the methods described herein, the cDNA pools were created from several different tissues by random priming the first strand cDNA from poly-A RNA, synthesizing the second strand cDNA by standard methods, and adding linkers to the ends of the cDNA fragments. The linkers are used to amplify the cDNA pools. The BAC clones are used as a template for in vitro DNA synthesis to create a biotin labeled copy of the BAC DNA. The biotin labeled copy of the BAC DNA is then denatured and incubated with an excess of the PCR amplified, Tinkered cDNA pools which have also been denatured. The BAC DNA and cDNA are allowed to anneal in solution, and heteroduplexes between the BAC and the cDNA are isolated using streptavidin coated magnetic beads. The cDNA which is captured by the BAC is then amplified using primers complimentary to the linker sequences, and the hybridization/selection process is repeated for a second round. After two rounds of direct cDNA selection, the cDNA fragments are cloned, and a library of these direct selected fragments is created.

The cDNA clones isolated by direct selection are analyzed by two methods. Since a pool of BACs from the HBM candidate region is used to provide the genomic DNA sequence, the cDNAs must be mapped to individual BACs. This is accomplished by arraying the BACs in microtiter dishes, and replicating their DNA in high density grids. Individual cDNA clones are then hybridized to the grid to confirm that they have sequence identity to an individual BAC from the set used for direct selection, and to determine the specific identity of that BAC. cDNA clones that are confirmed to correspond to individual BACs are sequenced. To determine whether the cDNA clones isolated by direct selection share sequence identity or similarity to previously identified genes, the DNA and protein coding sequences are. compared to publicly available databases using the BLAST family of programs.

The combination of genomic DNA sequence and cDNA sequence provided by BAC sequencing and by direct cDNA selection yields an initial list of putative genes in the region. The genes in the region were all candidates for the HBM locus. To further characterize each gene, Northern blots were performed to determine the size of the transcript corresponding to each gene, and to determine which putative exons were transcribed together to make an individual gene. For Northern blot analysis of each gene, probes were prepared from direct selected cDNA clones or by PCR amplifying specific fragments from genomic DNA or from the BAC encoding the putative gene of interest. The Northern blots gave information on the size of the transcript and the tissues in which it was expressed. For transcripts which were not highly expressed, it was sometimes necessary to perform a reverse transcription PCR assay using RNA from the tissues of interest as a template for the reaction.

Gene identification by computational methods and by direct cDNA selection provides unique information about the genes in a region of a chromosome. When genes are identified, then it is possible to examine different individuals for mutations in each gene.

The present invention also encompasses the HBM gene and HBM protein in the forms indicated by SEQ ID NO: 2 and 4, respectively, and other closely related variants, as well as the adjacent chromosomal regions of the HBM gene necessary for its accurate expression. In a preferred embodiment, the present invention is directed to an isolated nucleic acid sequence of SEQ ID NO: 2, as well as variants thereof. Variants of SEQ ID NO: 2 include polynucleotides having at least about 90%, preferably 95%, or more preferably 98% similarity or identity to the nucleic acid sequence of SEQ ID NO: 2 or fragments thereof. Therefore, sequences which are 96%, 97%, and 99% similar to SEQ ID NO: 2 or fragments thereof are also contemplated herein.

Determination of the degree of variation between a high bone mass (HBM) variant can be performed using BLAST or FASTA or other suitable algorithm using standard default parameters. Preferably, identity will be determined for coding regions of SEQ ID NO: 2, but can also include non-coding domains. Additionally, alignment programs can be used to identify conserved sequences or potential motifs across different animal species. Alignment programs can also be used to align the nucleic acid and/or protein sequences of related genes and the proteins that they encode. Preferred alignment programs include CLUSTALW, PILEUP and GAP, and would preferably be used with default parameters. For example, such programs can be used to align the sequences of LRP5 (also known as Zmax1), HBM, LDL receptor-related protein 6 (LRP6) and related sequences.

By a polynucleotide having a nucleotide sequence at least, for example, 90% "similar" to a reference nucleotide sequence encoding a polypeptide, is intended that the nucleotide sequence of the polynucleotide is identical to the reference sequence except that the polynucleotide sequence may include up to ten point mutations per each 100 nucleotides of the reference nucleotide sequence. These mutations of the reference sequence may occur at any location in SEQ ID NO: 2 and may be silent, or may or may not encode an amino acid substitution.

Figure 4:
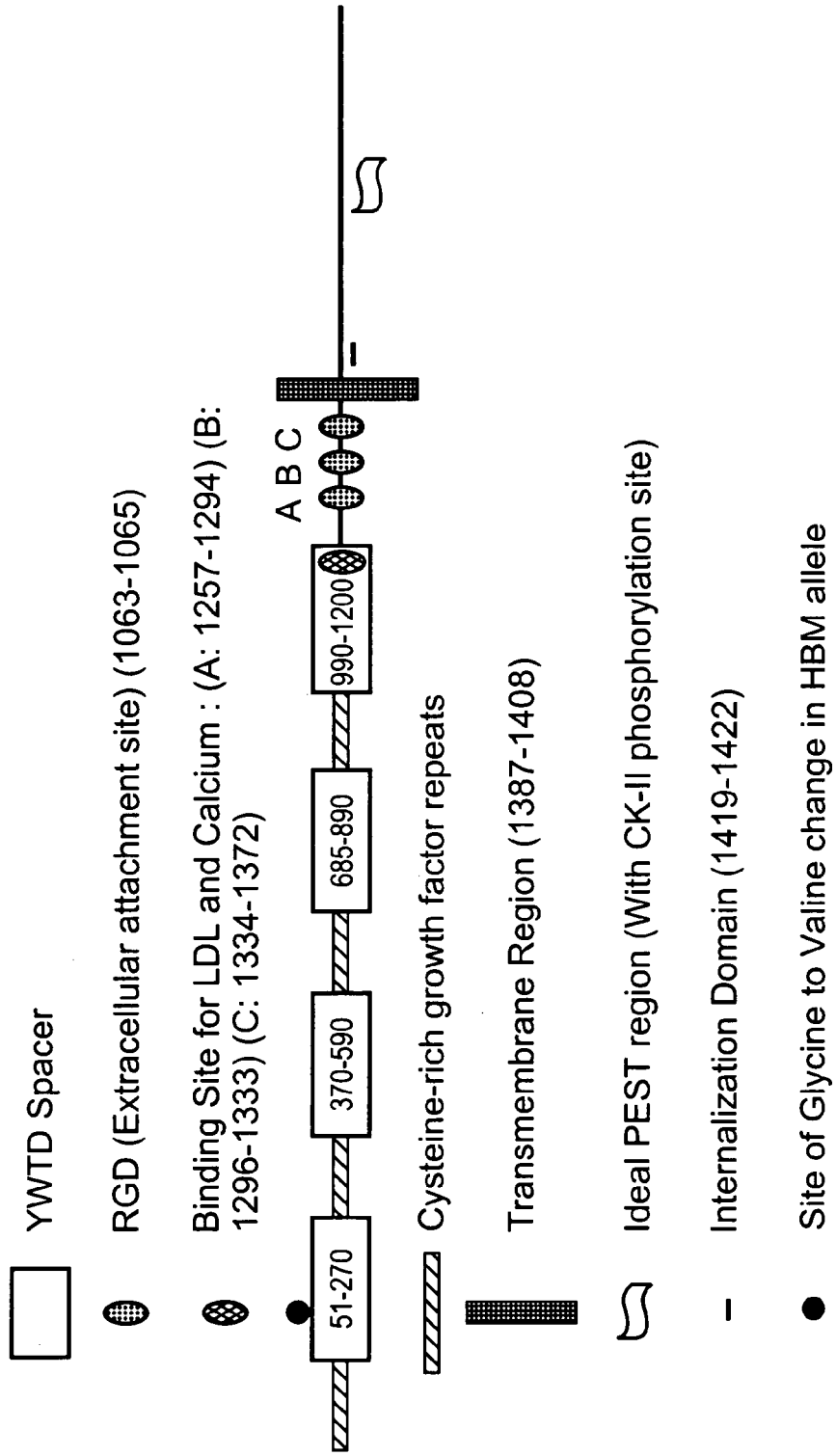
FIG. 4 shows the domain organization of LRP5 (Zmax1), including the YWTD spacers, the extracellular attachment site, the binding site for LDL and calcium, the cysteine-rich growth factor repeats, the transmembrane region, the ideal PEST region with the CK-II phosphorylation site and the internalization domain.

Another embodiment contemplates that such polynucleotide variants of SEQ ID NO: 2 comprise nucleic acid sequences which are at least 15, 20, 25, 30, 35, 40, 45, 50, 60, 70, 80, 90, 100, 150, 200, 300, 400, 500, or any number of contiguous nucleotides of SEQ ID NO: 2 in between. More preferably, such polynucleotide variants have a contiguous nucleic acid sequence corresponding with the polymorphism at nucleotide 582 (G→T substitution) of SEQ ID NO: 2 or other variants of SEQ ID NO: 2, which comprise a mutation which modulates bone mass when the polypeptide encoded thereby is administered to a subject. All variants of SEQ ID NO: 2 contemplated possess the characteristic of encoding a protein or polypeptide which when administered to a subject induces bone modulation. Additional variants which may be responsible for modulating bone mass when administered to a subject may lie within the domain known to contain the HBM polymorphism and which encodes the beta propeller domain (YWTD motifs). Alternatively, other variants of LRP5 which modulate bone mass and/or result in an HBM phenotype in a subject may be due to mutations in the nucleic acid sequences encoding any of the other conserved domains of LRP5, such as those set forth in FIG. 4 (e.g., the RGD extracellular attachment site, the binding site for LDL and calcium, the cysteine rich growth factor repeats, the ideal PEST region, and the internalization domain)

HBM polynucleotides contemplated include those which hybridize under stringent conditions to SEQ ID NO: 2. Hybridization methods are known in the art and include, but are not limited to: (a) washing with 0.1×SSPE (0.62 M NaCl, 0.06 M $NaH_2PO_4.H_2O$, 0.075 M EDTA, pH 7.4) and 0.1% sodium dodecyl sulfate (SDS) at 50° C.; (b) washing with 50% formamide, 5×SSC (0.75 M NaCl, 0.075 M sodium citrate), 50 mM sodium phosphate (pH 6-8), 0.1% sodium pyrophosphate, 5× Denhardt's solution, sonicated salmon sperm DNA (50 µg/ml), 0.1% SDS and 10% dextran sulfate at 42° C., followed by washing at 42° C. in 0.2×SSC and 0.1% SDS; and (c) washing with of 0.5 M $NaPO_4$, 7% SDS at 65° C. followed by washing at 60° C. in 0.5×SSC and 0.1% SDS. Additional conditions under which HBM variants can be isolated by hybridization to SEQ ID NO: 2 or nucleic acid fragments thereof can be performed by varying the hybridization temperature. High stringency hybridization conditions are those performed at about 20° C. below the melting temperature ($T_m$) of SEQ ID NO: 2 or fragments thereof. Preferred stringency is performed at about 5-10° C. below the $T_m$ of SEQ ID NO: 2 or fragments thereof. Additional hybridization conditions can be prepared as described in Chapter 11 of Sambrook et al., *Molecular Cloning: A Laboratory Manual* (1989), or as would be known to the artisan of ordinary skill.

Alternatively, mammalian libraries (e.g., equine, primate, caprine, bovine, ovine, feline, porcine, and canine) can be probed using degenerate primers and polymerase chain reaction (PCR) techniques to identify variants of SEQ ID NO: 2 or fragments thereof. Preferably primers are utilized which hybridize under stringent conditions to the open reading frame of SEQ ID NO: 2, or to non-coding portions of the sequence. More preferably, such primers hybridize to conserved domains within SEQ ID NO: 2. For example, conserved domains include those coding for the YWTD beta-propeller domains or other domains, such as those listed in FIG. 4. Preferred primers are typically 15 nucleotides in length, but can vary to be at least, about 16, 17, 18, 19, 20, 21, 22, 23, 24, 25, 30, 35, 40, or any integer number in between, nucleotides in length. Heterologous hybridization is to amplify the target gene or nucleic acid sequence using degenerate PCR primers. Probes for variants of SEQ ID NO: 2 and the polypeptide encoded thereby can be obtained by preparing mixed oligonucleotides of greater than 10, preferably of 15 or more, nucleotides in length representing all possible nucleotide sequences which could encode the corresponding amino acid sequences (e.g., SEQ ID NO: 4 fragments thereof). This method is clearly documented by Gould et al., 1989, *Proc. Natl. Acad. Sci. USA* 86(6): 1934-8.

Another embodiment includes nucleic acids which encode an HBM polypeptide which is at least about 90% similar to SEQ ID NO: 4 and fragments thereof, and which when administered to a subject modulate bone mass in that subject. Such HBM polypeptides include variants which have a valine corresponding to position 171 of SEQ ID NO: 4 (Gly to Val substitution) or 170 of the mouse homolog. Other preferred embodiments include high bone mass polypeptides which have at least about 10, 15, 20, 25, 30, 35, 40, 45, 50, 60, 70, 80, 90, 100, 150, 200, 250, 300, 500, or any integer number in between, or more, contiguous amino acids of SEQ ID NO: 4. Such contemplated contiguous sequences preferably overlap with a polymorphism corresponding to high bone mass, such as valine-171 of SEQ ID NO: 4. Also contemplated are the polynucleotides encoding polypeptides which are at least about 95%, 96%, 97%, 98% and 99% similar to SEQ ID NO: 4 and fragments thereof.

In another embodiment, a synthetic nucleic acid encoding SEQ ID NO: 4 is contemplated wherein the nucleic acid sequence has been conservatively substituted based on the degeneracy of the code such that no amino acids are altered in SEQ ID NO: 4, but perhaps wherein the resulting synthetic polynucleotide encoding said SEQ ID NO: 4 is one that is at least, about 50% similar to SEQ ID NO: 2.

By a polypeptide having an amino acid sequence of at least, for example, 95% "identity" to a reference amino acid sequence of SEQ ID NO: 4 or fragment thereof is intended that the amino acid sequence of the polypeptide is identical to the reference sequence except that the polypeptide sequence may include up to five amino acid alterations per each 100 amino acids of the reference amino acid sequence of SEQ ID NO: 4. In other words, to obtain a polypeptide having an amino acid sequence 95% identical to a reference amino acid sequence, up to 5% of the amino acid residues in the reference sequence may be deleted or substituted with another amino acid, or a number of amino acids up to 5% of the total amino acid residues in the reference sequence may be inserted into the reference sequence. These alterations of the reference sequence may occur at the amino or carboxy terminal positions of the reference amino acid sequence or anywhere between those terminal positions, interspersed either individually among residues in the reference sequence or in one or more contiguous groups within the reference sequence.

Additional HBM polypeptides and nucleic acids which encode said HBM polypeptides are contemplated wherein amino acid residues are conservatively substituted. For example, guidance concerning how to make phenotypically silent amino acid substitutions is provided in Bowie et al., "Deciphering the Message in Protein Sequences: Tolerance to Amino Acid Substitutions," *Science* 247: 1306-10 (1990), wherein the authors indicate that there are two main approaches for studying the tolerance of an amino acid sequence to change. The first method relies on the process of evolution, in which mutations are either accepted or rejected by natural selection. The second approach uses genetic engineering to introduce amino acid changes at specific positions of a cloned gene and selections or screens to identify sequences that maintain functionality. These studies have revealed that proteins are surprisingly tolerant of amino acid substitutions. The authors further indicate which amino acid changes are likely to be permissive at a certain position of the protein. Numerous phenotypic substitutions are described in Bowie et al., supra, and the references cited therein, which is herein incorporated by reference in its entirety. Preferred substitutions would be in domains which are less conserved across species, and which do not correspond to a structurally or functionally important domain (e.g., a binding site, catalytic site, or beta propeller or other domain described in FIG. 4).

Variants of LR P5/HBM

A structural model of the LRP5 first beta-propeller module was generated based on model predictions from two YWTD-propeller containing molecules (chicken LRP1 and human nidogen, with Swiss-PROT references LRP1_CH7 and NIDO_HU1 respectively) as described in Springer et al., (1998) *J. Molecular Biology*, 283:837-862. Based on the model, certain amino acid residues were identified as important variants of HBM/LRP5. The following three categories provide examples of such variants:

The shape of the beta-propeller resembles a disk with inward-sloping sides and a hole down the middle. Residue 171 is in a loop on the outer or top surface of the domain in blade 4 of propeller module 1. Thus, variants comprising changed residues in structurally equivalent positions in other blades; as well as residues that are slightly more interior to the binding pocket, but still accessible to the surface, are important embodiments of the present invention for the study of bone mass modulation by HBM, for the development of pharmaceuticals and treatments of bone mass disorders, and for other objectives of the present invention. The following are examples of such variants:

A214V (a position equivalent to 171 in blade 5; alanine is not conserved in other propellers), E128V (a position equivalent to 171 in blade 3; glutamate is not conserved in other propellers), A65V (a position equivalent to 171 in blade 2; alanine is conserved in propellers 1-3 but not 4), G199V (an accessible interior position in blade 5; glycine is conserved in propellers 1-3 but not 4), and M282V (accessible interior position in blade 1; methionine is conserved in propellers 1-3 but not 4).

LRP5 has four beta-propeller structures; the first three beta-propeller modules conserve a glycine in the position corresponding to residue 171 in human LRP5. Therefore, variants bearing a valine in the equivalent positions in the other propellers are important embodiments of the present invention. The following variants are useful for the study of bone mass modulation by HBM, for the development of pharmaceuticals and treatments of bone mass disorders, and for other objectives of the present invention: G479V, G781V, and Q1087V.

The G171V HBM polymorphism results in "occupied space" of the beta-propeller 1, with the side-chain from the valine residue sticking out into an open binding pocket and potentially altering a ligand/protein interaction. The glycine residue is conserved in LRP5 propellers 1, 2 and 3 but is a glutamine in propeller 4. Therefore, the following variants of HBM are important embodiments of the present invention for the study of bone mass modulation by HBM, for the development of pharmaceuticals and treatments of bone mass disorders, and for other objectives of the present invention:

G171K (which introduces a charged side-chain),
G171F (which introduces a ringed side-chain),
G171I (which introduces a branched side-chain), and
G171Q (which introduces the propeller 4 residue).

Although these variants are presented as examples, one of skill will recognize from the discussion herein that other variations on the sequence of LRP5 are within the scope of this invention. For example, corresponding variations in propellers 2 and 3, variations of residues in the vicinity of G171 in the structural model that result in perturbations of the space occupied by G171V in a 3D model, such perturbing variations in corresponding positions of other blades of propeller 1, and similar modifications to propellers 2 and 3. Each such variant can be incorporated by the methods described herein into animals and animal cells, separately or in combination and such transgenic cells and animals are useful for determining the specificity of the HBM effect and for making model systems to screen and identify compounds that can specifically mimic the HBM effect.

Furthermore, LRP6 is the closest homolog of LRP5. Thus, bone density can also be modulated by LRP6. LRP6 has a beta-propeller structure predicted to be similar, if not identical to LRP5. The position corresponding to glycine 171 in human LRP5 is glycine 158 of human LRP6. Therefore, corresponding variants of LRP6 are a useful embodiment of the present invention for the study of the specificity of effects related to LRP5 versus its related family member, for the development of pharmaceuticals and treatments of bone mass disorders, and for other objectives of the present invention. Specifically, for example, a glycine to valine substitution at the structurally equivalent position, residue 158, of human LRP6 and similar variants of other species' LRP6 homologs represent important research tools.

Moreover, it will be appreciated from the discussion which follows that it can be advantageous to modify the expression or activity of both LRP5 (Zmax1) and LRP6, as well as LRP5 and LRP6 individually. Wherever LRP5 or LRP6 are described herein, the skilled practitioner will recognize that corresponding individual reagents and combination reagents and methods are contemplated. Thus, such dually modified cells and animals, as well as reagents combining the capabilities of modifying both LRP5 and LRP6 and compositions of individual reagents such as expression vectors, gene targeting reagents, and activity and expression modifying molecules such as, for example, aptamers, antisense nucleotides, RNAi and the like, are aspects of the invention.

One skilled in the art will recognize that these are only a few illustrative examples presented to better describe the present invention and that many other variants may be contemplated within the scope of the present invention.

Methods of determining the bone mass modulating activity of a polypeptide or nucleic acid sequence encoding a polypeptide can be performed using different animal models for studying bone mass. For example, ovariectomized murine models or spontaneously osteoporotic mouse strains can be utilized to determine whether a LRP5 modulating agent correspondingly modulates bone mass in the animal model. For in vivo analysis of such mice, see Kalu et al., (1999) *J. Bone Miner. Res.* 14: 593-601 and Shimizu et al., (1999) *Mamm. Genome* 10: 81-7.

Additional in vivo assays which can be used are transgenic animals and knockout animals in which expression of LRP5 has been altered or the nucleic acid encoding HBM introduced. These animals can then be utilized to identify compounds or compositions which modulate bone mass.

The polypeptide of the present invention is preferably provided in an isolated form. By "isolated polypeptide" is intended a polypeptide removed from its native environment. Thus, a polypeptide produced and contained within a recombinant host cell would be considered "isolated" for purposes of the present invention. Also intended as an "isolated polypeptide" are polypeptides that have been purified, partially or substantially, from a recombinant host. Similarly, by "isolated nucleic acid" or "isolated polynucleotide" is meant a nucleic acid sequence which is purified from other nucleic acid and protein contaminants.

The present invention also encompasses the LRP5 gene and LRP5 protein in the forms indicated by SEQ ID NO: 1 and 3, respectively, and other closely related variants. The present invention also encompasses the adjacent chromosomal regions of LRP5 necessary for its accurate expression.

In a preferred embodiment, the present invention is directed to at least 15 contiguous nucleotides of the nucleic acid sequence of SEQ ID NO: 1. Variants of the LRP5 gene and LRP5 protein in the forms indicated by SEQ ID NOS: 1 and 3, respectively may be identified generally as described above for the HBM gene and HBM protein without the G171V HBM polymorphism.

The invention also relates to the nucleotide sequence of the LRP5 gene region, as well as the nucleotide sequence of the HBM gene region. More particularly, a preferred embodiment are the BAC clones containing segments of the LRP5 gene region B200E21-H and B527D12-H. A preferred embodiment is the nucleotide sequence of the BAC clones consisting of SEQ ID NOS: 5-12.

The invention also concerns the use of the nucleotide sequence to identify DNA probes for the LRP5 gene and the HBM gene, PCR primers to amplify the LRP5 gene and the HBM gene, nucleotide polymorphisms in the LRP5 gene and the HBM gene, and regulatory elements of the LRP5 gene and the HBM gene.

II. Phenotyping Using DXA Measurements

Spinal bone mineral content (BMC) and bone mineral density (BMD) measurements performed at Creighton University (Omaha, Nebraska) were made by DXA using a Norland Instruments densitometer (Norland XR2600 Densitometer, Dual Energy X-ray Absorptiometry, DXA). Spinal BMC and BMD at other locations used the machinery available. There are estimated to be 800 DXA machines currently operating in the U.S. Most larger cities have offices or imaging centers which have DXA capabilities, usually a Lunar or Hologic machine. Each location that provided spine BMC and BMD data included copies of the printouts from their machines to provide verification that the regions of interest for measurement of BMD have been chosen appropriately. Complete clinical histories and skeletal radiographs were obtained.

The HBM phenotype in human and animal subjects, preferably humans, can be described using criteria such as: very high spinal BMD; a clinical history devoid of any known high bone mass syndrome; and skeletal radiographs showing a normal shape of the appendicular skeleton.

III. Genotyping of Microsaterite Markers

To narrow the genetic interval to a region smaller than that originally reported by Johnson et al., *Am. J. Hum. Genet.*, 60:1326-1332 (1997), additional microsatellite markers on chromosome 11q12-13 were typed. The new markers included: D11S4191, D11S1883, D11S1785, D11S4113, D11S4136, D11S4139, (Dib, et al., *Nature*, 380:152-154 (1996), FGF3 (Polymeropolous, et al., *Nucl. Acid Res.*, 18:7468 (1990)), as well as GTC_HBM_Marker_1, GTC_HBM_Marker_2, GTC_HBM_Marker_3, GTC_HBM_Marker_4, GTC_HBM_Marker_5, GTC_HBM_Marker_6, and GTC_HBM_Marker_7 (See FIG. 2).

Blood (20 ml) was drawn into lavender cap (EDTA containing) tubes by a certified phlebotomist. The blood was stored refrigerated until DNA extraction. DNA has been extracted from blood stored for up to 7 days in the refrigerator without reduction in the quality or quantity of yield. For those subjects that have blood drawn at distant sites, a shipping protocol was successfully used on more than a dozen occasions. Blood samples were shipped by overnight express in a styrofoam container with freezer packs to provide cooling. Lavender cap tubes were placed on individual plastic shipping tubes and then into "zip-lock" biohazard bags. When the samples arrived the next day, they were immediately processed to extract DNA.

The DNA extraction procedure used a kit purchased from Gentra Systems, Inc. (Minneapolis, Minn.). Briefly, the procedure involved adding 3 volumes of a red blood cell lysis buffer to the whole blood. After incubations for 10 minutes at room temperature, the solution was centrifuged in a Beckman tabletop centrifuge at 2,000×g for 10 minutes. The white blood cell pellet was resuspended in Cell Lysis Buffer. Once the pellet was completely resuspended and free of cell clumps, the solution was digested with RNase A for 15 minutes at 37° C. Proteins were precipitated by addition of the provided Protein Precipitation Solution and removed by centrifugation. The DNA was precipitated out of the supernatant by addition of isopropanol. This method was simple and fast, requiring only 1-2 hours, and allowed for the processing of dozens of samples simultaneously. The yield of DNA was routinely >8 mg for a 20 ml sample of whole blood and had a MW of >50 kb. DNA was archived by storing coded 50 μg aliquots at −80° C. as an ethanol precipitate.

DNA was genotyped using one fluorescently labeled oligonucleotide primer and one unlabeled oligonucleotide primer. Labeled and unlabeled oligonucleotides were obtained from Integrated DNA Technologies, Inc. (Coralville, Iowa). All other reagents for microsatellite genotyping were purchased from Perkin Elmer-Applied Biosystems, Inc. ("PE-ABI") (Norwalk, Conn.). Individual PCR reactions were performed for each marker, as described by PE-ABI using AmpliTaq™ DNA Polymerase. The reactions were added to 3.5 μl of loading buffer containing deionized formamide, blue dextran and TAMRA 350 size standards (PE-ABI). After heating at 95° C. for 5 minutes to denature the DNA, the samples were loaded and electrophoresed as described in the operator's manual for the Model 377 DNA Sequencer (PE-ABI, Foster City, Calif.). After gel electrophoresis, the data was analyzed using PE-ABI GENESCAN™ and GENOTYPER™ software. First, within the GENESCAN™ software, the lane tracking was manually optimized prior to the first step of analysis. After the gel lane data was extracted, the standard curve profiles of each lane were examined and verified for linearity and size calling. Lanes, which had problems with either of these parameters, were re-tracked and verified. Once all lanes were tracked and the size standards were correctly identified, the data were imported into GENOTYPER™ for allele identification To expedite allele calling (binning), the program Linkage Designer from the Internet web-site of Dr. Guy Van Camp (alt.www.uia.ac.be/u/dnalab/ld.html) was used. This program greatly facilitates the importing of data generated by GENOTYPER™ into the pedigree drawing program Cyrillic (Version 2.0, Cherwell Scientific Publishing Limited, Oxford, Great Britain) and subsequent linkage analysis using the program LINKAGE (Lathrop et al., *Am. J. Hum. Genet.*, 37:482-498 (1985)).

IV. Linkage Analysis

Figure 1A:
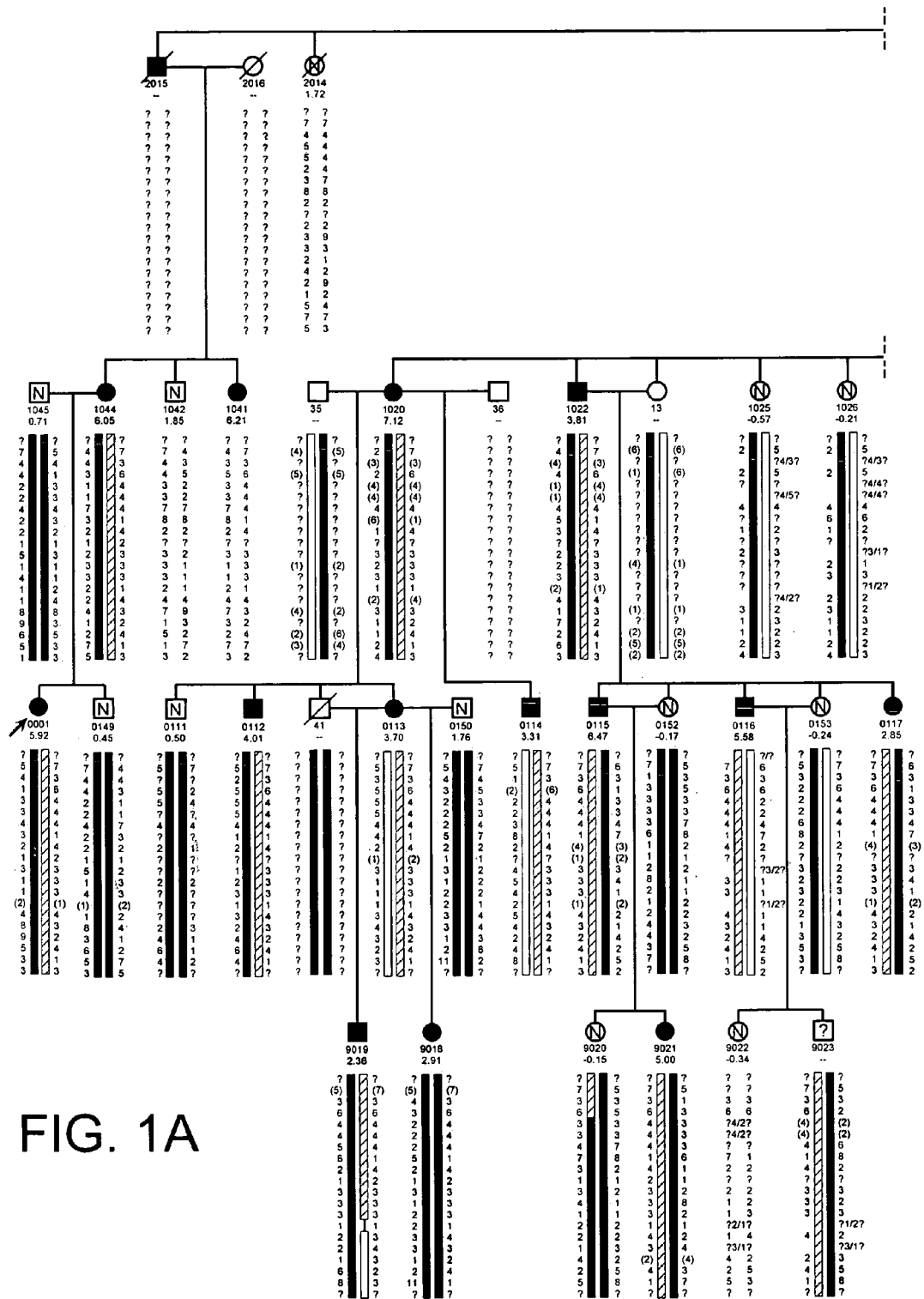
FIGS. 1A and 1B show the pedigree of the individuals used in the genetic linkage studies. Under each individual is an ID number, the z-score for spinal BMD, and the allele calls for the critical markers on chromosome 11. Solid symbols represent "affected" individuals. Symbols containing "N" are "unaffected" individuals. DNA from 37 individuals was genotyped. Question marks denote unknown genotypes or individuals who were not genotyped.
Figure 1B:
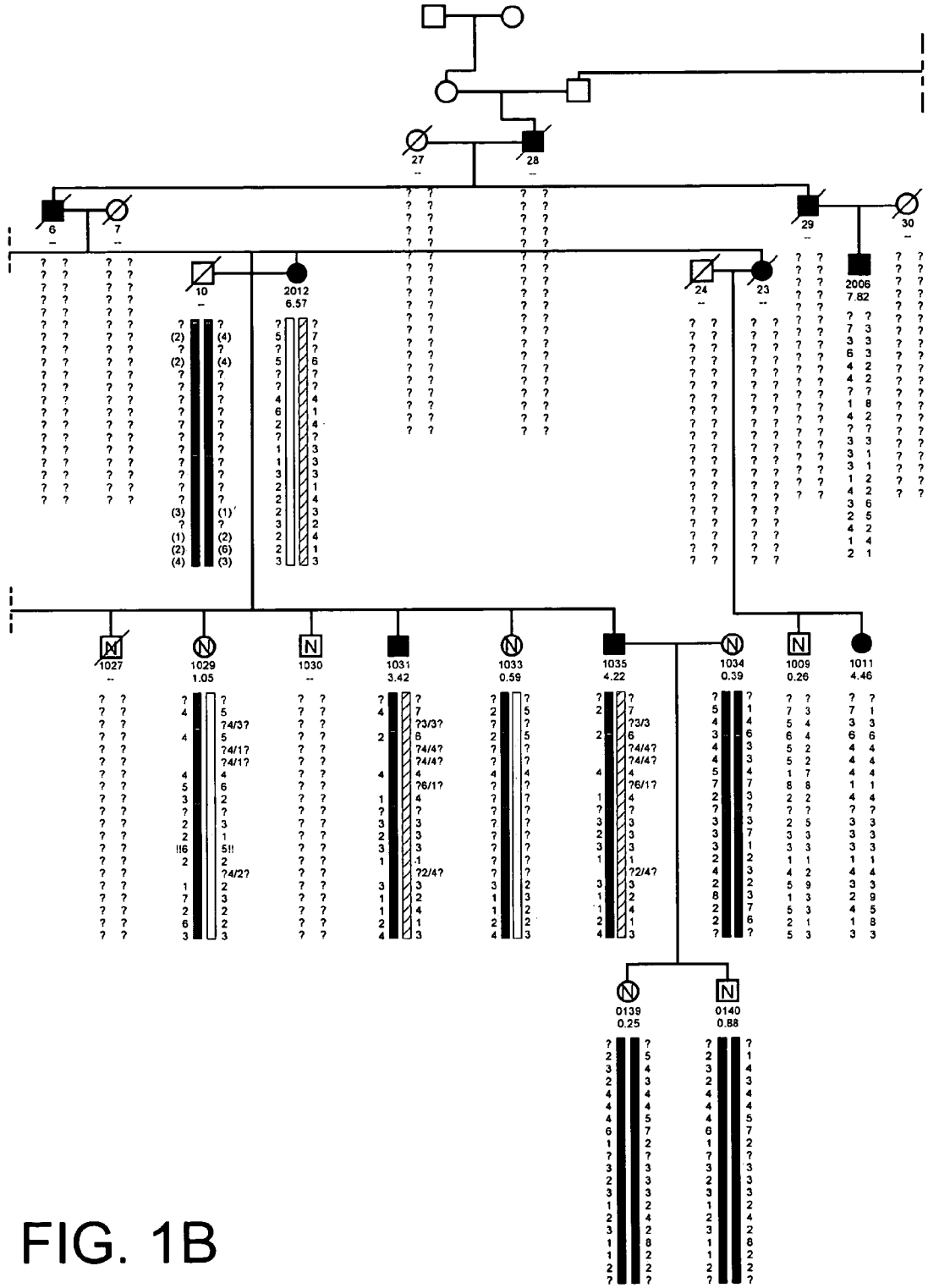

FIG. 1 demonstrates the pedigree of the individuals used in the genetic linkage studies for this invention. Specifically, two-point linkage analysis was performed using the MLINK and LINKMAP components of the program LINKAGE (Lathrop et al., Am. J. Hum. Genet., 37:482-498 (1985)). Pedigree/marker data was exported from Cyrillic as a pre-file into the Makeped program and converted into a suitable ped-file for linkage analysis.

The original linkage analysis was performed using three models: (i) an autosomal dominant, fully penetrant model, (ii) an autosomal dominant model with reduced penetrance, and (iii) a quantitative trait model. The HBM locus was mapped to chromosome 11q12-13 by analyzing DNA for linked markers from 22 members of a large, extended kindred. A highly automated technology was used with a panel of 345 fluorescent markers which spanned the 22 autosomes at a spacing interval ranging from 6-22 cM. Only markers from this region of chromosome 11 showed evidence of linkage (LOD score ~3.0). The highest LOD score (5.74) obtained by two-point and multipoint analysis was D11S987 (map position 55 in FIG. 2). The 95% confidence interval placed the HBM locus between markers D11S905 and D11S937 (map position 41-71 in FIG. 2). Haplotype analysis also places the LRP5 gene in this same region. Further descriptions of the markers D11S987, D11S905, and D11S937 can be found in Gyapay et al., Nature Genetics, Vol. 7, (1994).

In this invention, the inventors report the narrowing of the HBM interval to the region between markers D11S987 and GTC_HBM_Marker_5. These two markers lie between the delimiting markers from the original analysis (D11S905 and D11S937) and are approximately 3 cM from one another. The narrowing of the interval was accomplished using genotypic data from the markers D11S4191, D11S1883, D11S1785, D11S4113, D11S4136, D11S4139, (Dib et al., Nature, 380: 152-154 (1996)), FGF3 (Polymeropolous et al., Nucl. Acid Res., 18:7468 (1990)) (information about the genetic markers can be found at the internet site of the Genome Database, gdbwww.gdb.org), as well as the markers GTC_HBM_Marker_1, GTC_HBM_Marker_2, GTC_HBM_Marker_3, GTC_HBM_Marker_4, GTC_HBM_Marker_5, GTC_HBM_Marker_6, and GTC_HBM Marker_7.

As shown in FIG. 1, haplotype analysis with the above genetic markers identifies recombination events (crossovers) in individuals 9019 and 9020 that significantly refine the interval of chromosome 11 to which the LRP5 gene is localized. Individual 9019 is an HBM-affected individual that inherits a portion of chromosome 11 from the maternal chromosome with the HBM gene, and a portion from the chromosome 11 homologue. The portion inherited from the HBM gene-carrying chromosome includes markers D11S935, D11S1313, GTC_HBM_Marker_4, D11S987, D11S1296, GTC_HBM_Marker_6, GTC_HBM_Marker_2, D11S970, GTC_HBM_Marker_3, D11S4113, GTC_HBM_Marker_1, GTC_HBM_Marker_7 and GTC_HBM_Marker_5. The portion from D11S4136 and continuing in the telomeric direction is derived from the non-HBM chromosome. This data places the LRP5 gene in a location centromeric to the marker GTC_HBM_Marker_5. Individual 9020 is an unaffected individual who also exhibits a critical recombination event. This individual inherits a recombinant paternal chromosome 11 that includes markers D11S935, D11S1313, GTC_HBM_Marker_4, D11S987, D11S1296 and GTC_HBM_Marker_6 from her father's (individual 0115) chromosome 11 homologue that carries the HBM gene, and markers GTC_HBM_Marker_2, D11S970, GTC_HBM_Marker_3, GTC_HBM_Marker_1, GTC_HBM_Marker_7, GTC_HBM_Marker_5, D11S4136, D11S4139, D11S1314, and D11S937 from her father's chromosome 11 that does not carry the HBM gene. Marker D11S4113 is uninformative due to its homozygous nature in individual 0115. This recombination event places the centromeric boundary of the HBM region between markers D11S1296 and D11S987.

Two-point linkage analysis was also used to confirm the location of the LRP5 gene on chromosome 11. The linkage results for two point linkage analysis under a model of full penetrance are presented in Table 1 below. This table lists the genetic markers in the first column and the recombination fractions across the top of the table. Each cell of the column shows the LOD score for an individual marker tested for linkage to the LRP5 gene at the recombination fraction shown in the first row. For example, the peak LOD score of 7.66 occurs at marker D11S970, which is within the interval defined by haplotype analysis.

TABLE 1

| Marker | 0.0 | 0.05 | 0.1 | 0.15 | 0.2 | 0.25 | 0.3 | 0.35 | 0.4 |
|---|---|---|---|---|---|---|---|---|---|
| D11S935 | −infinity | 0.39 | 0.49 | 0.47 | 0.41 | 0.33 | 0.25 | 0.17 | 0.10 |
| D11S1313 | −infinity | 2.64 | 2.86 | 2.80 | 2.59 | 2.30 | 1.93 | 1.49 | 1.00 |
| D11S987 | −infinity | 5.49 | 5.18 | 4.70 | 4.13 | 3.49 | 2.79 | 2.03 | 1.26 |
| D11S4113 | 4.35 | 3.99 | 3.62 | 3.24 | 2.83 | 2.40 | 1.94 | 1.46 | 0.97 |
| D11S1337 | 2.29 | 2.06 | 1.81 | 1.55 | 1.27 | 0.99 | 0.70 | 0.42 | 0.18 |
| D11S970 | 7.66 | 6.99 | 6.29 | 5.56 | 4.79 | 3.99 | 3.15 | 2.30 | 1.44 |
| D11S4136 | 6.34 | 5.79 | 5.22 | 4.61 | 3.98 | 3.30 | 2.59 | 1.85 | 1.11 |
| D11S4139 | 6.80 | 6.28 | 5.73 | 5.13 | 4.50 | 3.84 | 3.13 | 2.38 | 1.59 |
| FGF3 | 0.59 | 3.23 | 3.15 | 2.91 | 2.61 | 2.25 | 1.84 | 1.40 | 0.92 |
| D11S1314 | 6.96 | 6.49 | 5.94 | 5.34 | 4.69 | 4.01 | 3.27 | 2.49 | 1.67 |
| D11S937 | infinity | 4.98 | 4.86 | 4.52 | 4.06 | 3.51 | 2.88 | 2.20 | 1.47 |

A single nucleotide polymorphism (SNP) further defines the HBM region. This SNP is termed SNP_Contig033-6 and is located 25 kb centromeric to the genetic marker GTC_HBM_Marker_5. This SNP is telomeric to the genetic marker GTC_HBM_Marker_7. SNP_Contig033-6 is present in HBM-affected individual 0113. However, the HBM-affected individual 9019, who is the son of 0113, does not carry this SNP. Therefore, this indicates that the crossover is centromeric to this SNP. The primer sequence for the genetic markers GTC_HBM_Marker_5 and GTC_HBM$_{13}$ Marker_7 is shown in Table 2 below.

TABLE 2

| Marker | Primer (Forward) | Primer (Reverse) |
|---|---|---|
| GTC_HBM_ Marker_5 CG | TTTTGGGTACACAATTCAGT (SEQ ID NO:63) | AAAACTGTGGGTGCTTCTGG (SEQ ID NO:65) |
| GTC_HBM_ Marker_7 GA | GTGATTGAGCCAATCCTGA (SEQ ID NO:64) | TGAGCCAAATAAACCCCTTCT (SEQ ID NO:66) |

The kindred described have several features of great interest, notably that their bones, while very dense, have an absolutely normal shape. The outer dimensions of the skeletons of the HBM-affected individuals are normal, and, while medullary cavities are present, there is no interference with hematopoiesis. The HBM-affected members seem to be resistant to fracture, and there are no neurologic symptoms, and no symptoms of impairment of any organ or system function in the members examined. HBM-affected members of the kindred live to advanced age without undue illness or disability. Furthermore, the HBM phenotype matches no other bone disorders such as osteoporosis, osteoporosis pseudoglioma, Engelmann's disease, Ribbing's disease, hyperphosphatasemia, Van Buchem's disease, melorheostosis, osteopetrosis, pycnodysostosis, sclerostenosis, osteopoikilosis, acromegaly, Paget's disease, fibrous dysplasia, tubular stenosis, osteogenesis imperfecta, hypoparathyroidism, pseudohypoparathyroidism, pseudopseudohypoparathyroidism, primary and secondary hyperparathyroidism and associated syndromes, hypercalciuria, medullary carcinoma of the thyroid gland, osteomalacia and other diseases. Clearly, the HBM locus in this family has a very powerful and substantial role in regulating bone density, and its identification is an important step in understanding the pathway(s) that regulate bone density and the pathogenesis of diseases such as osteoporosis.

In addition, older individuals carrying the HBM gene, and therefore expression of the HBM protein, do not show loss of bone mass characteristic of normal individuals. In other words, the HBM gene is a suppressor of osteoporosis. In essence, individuals carrying the HBM gene are dosed with the HBM protein, and, as a result, do not develop osteoporosis. This in vivo observation is strong evidence that treatment of normal individuals with the HBM gene or protein, or a fragment thereof, will ameliorate osteoporosis.

V. Physical Mapping

To provide reagents for the cloning and characterization of the HBM locus, the genetic mapping data described above were used to construct a physical map of the region containing LRP5 on chromosome 11q13.3. The physical map consists of an ordered set of molecular landmarks, and a set of BAC clones that contain the LRP5 gene region from chromosome 11q13.3.

Various publicly available mapping resources were utilized to identify existing STS markers (Olson et al., *Science*, 245:1434-1435 (1989)) in the HBM region. Resources included the GDB, the Whitehead Institute Genome Center, dbSTS and dbEST (NCBI), 11 db, the University of Texas Southwestern GESTEC, the Stanford Human Genome Center, and several literature references (Courseaux et al., *Genomics*, 40:13-23 (1997), Courseaux et al., *Genomics*, 37:354-365 (1996), Guru et al., *Genomics*, 42:436-445 (1997), Hosoda et al., *Genes Cells*, 2:345-357 (1997), James et al., *Nat. Genet.*, 8:70-76 (1994), Kitamura et al., *DNA Research*, 4:281-289 (1997), Lemmens et al., *Genomics*, 44:94-100 (1997), Smith et al., *Genome Res.*, 7:835-842 (1997)). Maps were integrated manually to identify markers mapping to the region containing LRP5.

Primers for existing STSs were obtained from the GDB or literature references are listed in Table 3 below. Thus, Table 3 shows the STS markers used to prepare the physical map of the LRP5 gene region.

TABLE 3

HBM STS Table

| STS Name | Locus Name | Type | GDB Access. | Size (kb) | SEQ ID NO: Forward Primer | SEQ ID NO: Reverse Primer | Gene Name |
|---|---|---|---|---|---|---|---|
| ACTN3 | | Gene | GDB: 197588 | 0.164 | 67: CTGGACTACGTGGCCTTCTC | 68: TTCAGAAGCACTTGGCTGG | Actinin, alpha 3-skeletal muscle |
| PC-B/PC-Y | | Gene | GDB: 197884 | 0.125 | 69: CTCAGTGCATGAAGATGGA | 70: CAAGATCACTCGATCTCCAGG | Pyruvate Carboxylase |
| ADRBK1 | D11S2161E | Gene | | 0.322 | 71: GTTTCAGGAGACTCAGAGTC | 72: TTCTGCAGGTTGCTGTTGAG | Adenosine Receptor (A2) Gene |
| PSANK3 | | Gene | GDB: 4590179 | 0.117 | 73: TTATTGTGATTTCCCGTGGC | 74: GCCCTCTGTCCTGACTTCAGG | Beta-adrenergic receptor kinase |
| | | GENE | | 0.259 | 75: GAGAAAGAAATAAGGGACC | 76: TGCTTTGTAAAGCACTGAGA | sim. to Human endogenous retrovirus mRNA long terminal repeat |
| PP1(1/2)/PP1(2/2) | | Gene | GDB: 197566 | 0.208 | 77: GAAGTACGGCCAGTTCAGTGGCCT | 78: ATACACCAAGGTCCATGTTCCCGT | Protein phosphatase 1, catalytic sub-unit, alpha isoform |
| GSTP1.PCR1 | | Gene | GDB: 270068 | 0.19 | 79: AGCCTGGGCCACAGCGTGAGACTACGT | 80: TCCCGGAGCTTGCACACCCGCTTCACA | Glutathione S-transferase pl |
| NDUFV1 | | Gene | | 0.521 | 81: CATGTGCCCACCTCATTCAT | 82: CAAGATTCTGTAGCTTCTGG | NADH dehydrogenase (ubiquinone) flavoprotein 1 (51 kD) |
| PSANK2 | | GENE | | 0.157 | 83: CAGAGAAGTCAAGGACTTG | 84: ATCCTCTCCACATCCCACACT | Aldehyde De-hydrogenase 8 (ALDH8) |
| PSANK1 | | EST | | 0.3 | 85: CAAGGCTAAAAGACGAAAAA | 86: TCAGGAGCATTTCATCTTTT | Human ribosomal protein L37 (PSANK1) pseudogene. |
| UT5820 | D11S1917 | MSAT | GDB: 314521 | 0.211 | 87: AAGTCGAGGCTGCAAGGAG | 88: GCCCTGTGTTCCTTTCAGTA | |
| AFM289ya9 | D11S1337 | MSAT | GDB: 199805 | 0.287 | 89: AAGGTGTGAGGATCACTGG | 90: AGTCATGGGGCTATT | |
| GALN | | Gene | | 0.322 | 91: GCTTCTCCGAGTGTATCAAC | 92: ATGGCAGAGGACTTAGAACA | Preprogalanin (GAL1) |
| pMS51 | D11S97 | VNTR | GDB: 177850 | | 93: GATCAGCGAACTTCCTCTCGGCTC | 94: TCCACATTGAGGACTGTGGGAACG | |
| BCL1(1)/BCL1(2) | | Gene | | 0.205 | 95: GCTAATCACAGTCTACCGA | 96: TTGCACTGTCTTGGATGCA | B-cell CLL/lymphoma 1-Cyclin D1 (PRAD1 gene) |
| CCND1 | | Gene | GDB: 4590141 | 0.248 | 97: GCACACTGTAGTGTGGGGTTCTAGGC | 98: CAGGGCGAAAGGACATGCACACGGC | Cyclin D1 |

TABLE 3-continued

HBM STS Table

| STS Name | Locus Name | Type | GDB Access. | Size (kb) | SEQ ID NO: Forward Primer | SEQ ID NO: Reverse Primer | Gene Name |
|---|---|---|---|---|---|---|---|
| FGF4 | | Gene | GDB: 4590113 | 0.549 | 99: CACCGATGAGTGCACGTTCAAGGAG | 100: CAGACAGATGCTCCACGCCATAC | Fibroblast growth factor 4 |
| FGF3.PCR1 | | Gene | GDB: 188827 | 0.161 | 101: TTTCTGGGTGTCTGAAT | 102: ACACAGTTGCTCTAAAGGGT | Fibroblast growth factor 3 |
| AFM164ZF12 | D11S913 | MSAT | GDB: 188151 | 0.22 | 103: CATTTGGGAAATCCAGAAGA | 104: TAGGTGTCTTATTTTTTGTTGCTTC | |
| AFMA190YD5 | | MSAT | GDB: 1222326 | 0.275 | 105: GACATACCATGACAACACTATAAGAGG | 106: CAACCCATACCAGGGATAAG | |
| SHGC-15295 | | STS | GDB: 740600 | 0.147 | 107: GAACAAGAGAGGGTAAGTTGGC | 108: TGAGGACACAGATACTGATGGG | |
| SHGC-3084 | | STS | GDB: 740102 | 0.167 | 109: GAAGTTGTTCCCTCTTAAATTCTTTG | 110: GAACTATATATTGTAGTTAGTGAGGAG | |
| SHGC-14407 | D11S4540 | STS | GDB: 740518 | 0.158 | 111: CCTGTAACCCCCAGTCCC | 112: TCTTGCTTCCTAAGTTTCTCG | |
| SHGC-10946 | D11S4684 | Gene | GDB: 874522 | 0.311 | 113: ACTCCATCCACCTCATCACTG | 114: TGCTGTTTGCCTCATCTGAC | Choline Kinase |
| S515 | D11S4327 | STS | GDB: 196290 | 0.166 | 115: GTGGACAGGCATAGCTGAGG | 116: TGTTCACTCTTCTGCCTGCAG | |
| AFM147XD10 | D11S703 | MSAT | GDB: 307895 | 0.183 | 117: AGCTGGACTCTCACAGAATG | 118: CAAGAGGCTGGTAGAAGTG | |
| AFMA131YE5 | D11S1889 | MSAT | GDB: 195002 | 0.082 | 119: GACTCCAGTCTGGGCAATAAAAGC | 120: GGTGGCAGCATGACCTCTAAAG | |
| AFMb358xa9 | D11S987 | MSAT | GDB: 611922 | 0.237 | 121: CAGGCCCAGTCTCTTG | 122: CGTGTCCAGATGAAAGTG | |
| AFMa272yb5 | D11S4178 | MSAT | GDB: 608115 | 0.218 | 123: ACCTTCACGGTGTAATCCC | 124: CTTGAAGCCCATCTTTGC | |
| WI-17803 | D11S4113 | EST | GDB: 4581644 | 0.15 | 125: TATTTGCAAAGCTTGAGACTTCT | 126: AATCACTGTGCTTTGTTGCC | |
| SGC31823 | | EST | GDB: 4578806 | 0.126 | 127: ACTTTATTGTCAGCGTGGGC | 128: ACTCCCTCGATGGCTTCC | |
| WI-7741 | D11S4364 | GENE | GDB: 677652 | 0.324 | 129: GAGCAGGGGAGAGAAGGC | 130: CCCAACTGGCTTGTGTTTTATTG | Transformation-sensitive protein IEF SSP 3521 |
| SGC35223 | | EST | GDB: 4582598 | 0.13 | 131: AGCCACTTTATTGTTATTTGATGC | 132: AAGAGTGAACAAAAGCAAACATACC | ZNF162-splicing factor 1 |
| WI-18754 | | EST | GDB: 4578377 | 0.15 | 133: GTGGAGTGTGGGATTGG | 134: TACTGTTCTTGATAAGTATGTCGGC | |
| WI-6315 | D11S4418 | EST | GDB: 678804 | 0.224 | 135: ATGCTTTTGCATGATTCTAATTATT | 136: TCCCCCAAAAGAATGTAAAGG | |
| WI-16915 | | EST | GDB: 4584055 | 0.125 | 137: CTGGTCTTCCTTGTGTGCTG | 138: ATCACCCAGGCCAGGGAT | Mitogen inducible gene (MIG-2) |
| SGC30608 | | EST | | 0.128 | 139: TCAGAGACAGAACTGTTTTAACA | 140: CCTGCTTGAAAGTTCTAGAGCC | |

TABLE 3-continued

HBM STS Table

| STS Name | Locus Name | Type | GDB Access. | Size (kb) | SEQ ID NO: Forward Primer | SEQ ID NO: Reverse Primer | Gene Name |
|---|---|---|---|---|---|---|---|
| WI-17663 | | EST | GDB: 4583346 | 0.126 | 141: CAAGCCGGGTTTATTGAAA | 142: GATGCCAGGACCATGGAC | |
| WI-6383 | | Gene | GDB: 1222237 | 0.199 | 143: GCATATAGAAACAATTTATTGCCG | 144: CTCTGAAGCAGGGACCAGAG | Human tat interactive protein (TIP60) |
| SGC31567 | | Gene | GDB: 4578432 | 0.207 | 145: CTACGACACCACACCAGGC | 146: CAAGCGAAAGTCGCCTTC | Calcium activated neutral protease large subunit, muCANP, calpain |
| SGC30658 | | EST | GDB: 4584037 | 0.15 | 147: GTTGTCTTGACTTCAGGTCTGTC | 148: TTTTCCTTCAACAATCACTACTCC | |
| SGC34590 | | EST | GDB: 1222235 | 0.13 | 149: GCGTGGGGATATAGAGGTCA | 150: TACGTGGCCAAGAAGCTAGG | |
| SGC33927 | | EST | GDB: 4582382 | 0.15 | 151: TAATATATCCCCAGTCTAAGGCAT | 152: AGCTTGCAGATGAGCCC | |
| WI-8871 | | EST | GDB: 1222235 | 0.124 | 153: TGGTTTTAAACCTTTAATGAGAAAA | 154: TGTTGATCTATACCCTGTTTCCG | |
| WI-12334 | | EST | GDB: 1222257 | 0.127 | 155: AATTATTTAAAAGAGAGGAAAGGCA | 156: TGGCTGTGAACTTCCTCTGA | |
| WI-18402 | | EST | GDB: 4581874 | 0.113 | 157: GGTTACAGAGAAAACATTTGAGAGAT | 158: TGAGCTTTAGTTCCCTTCTCTG | |
| WI-18871 | | EST | GDB: 4584947 | 0.131 | 159: TTGAAAAACCATTTATTTCACCG | 160: TCTGCGGCTGTTGGATTT | Hlark |
| WI-12856 | | EST | GDB: 4576606 | 0.209 | 161: TTGAAAAACCATTTATTTCACCG | 162: TGTTCTCTTTCTCCCAGCAGG | Hlark |
| SGC33767 | | EST | GDB: 4581106 | 0.15 | 163: CTTTATTGAAAACATTGAGTGCA | 164: TTGTCAAATTCCCCCCAAAA | |
| AFM343YB5 | | MSAT | GDB: 1222332 | 0.181 | 165: AAACCACGACCNCCAA | 166: CCCTGAAAGGTAAGATGCT | |
| SGC33744 | | EST | GDB: 4575826 | 0.15 | 167: CTTTTGGTAGAGACAAGGTCTCA | 168: TATCTGTCTGTAGTGCTTCAAATGT | |
| SGC32272 | | EST | GDB: 4581592 | 0.135 | 169: GACGAAGGTGATTCAGGGC | 170: ACTGAAGAACTCTTGTCCT | |
| SGC34148 | | EST | GDB: 4583084 | 0.1 | 171: CAGATAAAAGAGTCACTATGGCTCA | 172: CACTTCTCCCACTTTGTCCC | |
| WI-18546 | | EST | GDB: 4574598 | 0.133 | 173: TTATTGATAAGCATTAGTGAACCCC | 174: TGGCAAGTTAGGCACAGTCA | Human 1.1 kb mRNA upregulated in retinoic acid treated HL-60 neutrophilic cells |
| SGC31103 | | EST | GDB: 4567265 | 0.1 | 175: CTATGCCCAGAGATGAACAGG | 176: TCCACTAAGGGCTATGTCGC | |
| SGC30028 | | Gene | GDB: 4580505 | 0.128 | 177: GCCAGCTTTATTGAGTAAACTTCC | 178: CACTGGAGACTACAAGTGGTGG | Human pyruvate carboxylate precursor |
| WI-2875 | D11S4407 | STS | GDB: 678546 | 0.125 | 179: CATCCCAACCATCACTCAGT | 180: GGGGACTAGCTTACAGATTTGA | |

TABLE 3-continued

HBM STS Table

| STS Name | Locus Name | Type | GDB Access. | Size (kb) | SEQ ID NO: Forward Primer | SEQ ID NO: Reverse Primer | Gene Name |
|---|---|---|---|---|---|---|---|
| SGC36985 | | Gene | GDB: 4577182 | 0.223 | 181: AGACTACATTTTGGACCAGTGG | 182: TGAAAGGATATTTATAGCCTGGA | LAR-interacting protein 1b |
| GCT16807 | D11S4270 | STS | GDB: 626245 | 0.137 | 183: GAAGGTTTTGTCCCTCGATC | 184: TGAGGGTTGGGAAGATCATA | |
| WI-8504 | D11S3974 | EST | GDB: 588142 | 0.174 | 185: CCTTCATAGCCACACCCG | 186: CAGCTAACTGTTGACATGCCA | |
| SGC31049 | | EST | GDB: 4580093 | 0.15 | 187: TCTTTACTGTGCTTACAACTTTCCT | 188: CAACAGTGCAGTCGGTATCG | |
| TIGR-AD02J17 | | EST | GDB: 1222193 | 0.199 | 189: AGATCAGCAAGCAGATAG | 190: CATTCCACATGGATAGAC | NDUFV1 |
| WI-5996 | | EST | GDB: 458683 | 0.1 | 191: CATACCTATGAGGTGTGCTACAGG | 192: GCATTTTCTCATCATCCTTGC | amplaxin (EMS1) |
| WI-16987 | | EST | GDB: 4575848 | 0.15 | 193: TTACAGCCACCAAGGTTTCC | 194: AGTGTGTGTGCCAGGTTGA | Nuclear mitiotic appratus protein 1, NUMA |
| SGC31912 | | EST | GDB: 4587868 | 0.101 | 195: CACTGTTATGTCATTAACTGTGAGG | 196: TTTGATTTTGTGTCTCCCAAA | |
| WI-13500 | | EST | GDB: 4577893 | 0.15 | 197: CCCCACTCCCACTTTTCATTT | 198: CCAGTCACCTTTACTAGTCCTTTG | |
| CHLC.GAAT1B01.P7933 | D11S971 | MSAT | GDB: 684255 | 0.103 | 199: AGGACACAGCCTGCATCTAG | 200: ACCAGGCATTGCACTAAAAG | |
| SGC35519 | | Gene | GDB: 4577180 | 0.134 | 201: GATGGGTCACACTAACCTGTCA | 202: ACATTATATATTGGACATGCAACC | LAR-interacting protein 1a mRNA |
| WI-11974 | | EST | GDB: 1222255 | 0.108 | 203: AGCATCTTTTATGTGTCAGGCA | 204: ATGTGCTGGGCTGGAAAG | Carnitine palmitoyl transferase I |
| WI-15244 | | Gene | GDB: 4574740 | 0.108 | 205: TCACATTCAAAAATCGGCAA | 206: CTGCCTGTGTGGTGTCGC | Beta-adrenergic receptor kinase 1, ADRB1 |
| WI-17496 | | EST | GDB: 4583336 | 0.131 | 207: TGTTTTATTTCTCAGTACAAAGCCA | 208: GACCTCCTGTGACCACACG | |
| WI-9159 | D11S4381 | EST | GDB: 678144 | 0.111 | 209: CCACCAAATTATTATAGTTCTGCG | 210: GTAAGATTCTCCACTGTTGCACC | |
| WI-4232 | | STS | GDB: 1222250 | 0.175 | 211: CCTATAATGGGCTGGACCAA | 212: ACTCCTCATGTGAAGTCACCG | |
| SHGC-4187 | | EST | GDB: 4568789 | 0.161 | 213: CAGTGTGCACGTTTTCATTT | 214: CAGCATCTTCAGCACTTACC | FGF4 |
| WI-14303 | | EST | GDB: 4576938 | 0.15 | 215: CTGCATTATTATGAGAATCAACAG | 216: TGCTGCTGGGAGTCAGAGTC | |
| WI-16597 | | EST | GDB: 4585686 | 0.13 | 217: CAGGGCACTGAGATACACTTACC | 218: AAGGATCAAGCAGGCATTTG | |
| RC29S1CATTFOR/RC29S1CATT | D11S970 | MSAT | GDB: 191084 | 0.15 | 219: ACACATCTCTTCTGTGCCCC | 220: TGAACCCTGGAGGCAGAG | Human DNA helicase gen (SMBP2) |

TABLE 3-continued

HBM STS Table

| STS Name | Locus Name | Type | GDB Access. | Size (kb) | SEQ ID NO: Forward Primer | SEQ ID NO: Reverse Primer | Gene Name |
|---|---|---|---|---|---|---|---|
| UT979 | D11S1296 | MSAT | GDB: 198525 | 0.382 | 221: CATTCCCAGTTTGCAGAC | 222: GTGCTGGGATTACAGGTGT | |
| 1281/1282 | D11S1959E | EST | GDB: 335216 | 0.07 | 223: GCAGAGAAGTCCTGTTAGCC | 224: CCATGCTAGAGAAGCACAAC | |
| D11S488 | D11S488 | STS | | 0.096 | 225: AGTGTGGGCAGGACCTCTG | 226: CAGACAGATAGCCCTGGGTTC | |
| D11S668 | D11S868 | STS | GDB: 179349 | 0.143 | 227: TCCCTCATCCCCTTGTCTGT | 228: AGCCCCCCCTGGGATAATC | |
| RH18048 | | Gene | GDB: 4572853 | 0.188 | 229: GATGCTTACCTACCACGGC | 230: AGGATTCCTATCTGGGCTATG | Aldehyde dehydrogenase (ALDH8) |
| IGHMBP2 | | Gene | GDB: 4590087 | 0.699 | 231: TGGCAGACCATGCTCCGCCT | 232: GAGAAGGCCGGGAGGCTCTG | Human DNA helicase gen (SMBP2) |
| NUMA | | Gene | GDB: 4590244 | 0.277 | 233: CTCCATCACAACCAGATTTGAGGCT | 234: GGGTGTGAGCTGCTGCTGAAGG | Nuclear mititic apparatus protein 1, NUMA |
| KRN1 | | Gene | GDB: 4590232 | 0.228 | 235: AGTGGGAAACCTCAGTAGCTCCCGA | 236: CAGTTTGGCTCAGACATATGGGGGCA | High sulphur keratin, KRN |
| Cda1/106 | D11S2302E | EST | GDB: 445887 | 0.091 | 237: CATTAAGTAGTGGGGGACAG | 238: CAAAGCGACAGTGAGTTAGGG | |
| RH10753 | | Gene | GDB: 4563588 | 0.194 | 239: GGAGTAGACCATGATTACTG | 240: CATGGTCTATTTATTCTCG | protein phosphatase 2A, PP2A |
| EMS1 | | Gene | GDB: 459016 | 0.64 | 241: CGCCCTCGGATCCTCACACTACA | 242: GGGCATCAGGGGATGGGTAGA | Amplaxin |
| SHGC-11098 | DXS9736 | Gene | GDB: 737674 | 0.137 | 243: GCTCCTATCTGTGTTTTGAATGG | 244: CCGTGGCATAAGATAAGTAAACG | Androgen Receptor |
| INPPL1 | | Gene | GDB: 4590093 | 0.382 | 245: CTTGGAGCGCTATGAGGAGGGC | 246: ATGGCAACTGACCTTCCGTCCTG | 51C protein Inositol polyphosphate phosphatase-Eke 1 |
| RH18051 | | EST | GDB: 4572859 | 0.195 | 247: TTGGAGTCACAGGGGC | 248: CAGCACTATCCTTGGGG | NOF1 |
| Cda1cc11 | D11S2297E | EST | GDB: 445889 | 0.1 | 249: AACAAAGCTGCTTAGCACCTG | 250: GATGAGGACCAACTGGTGAC | |
| 1249/1250 | D11S1957E | EST | GDB: 335210 | 0.247 | 251: TTTTCCAATAATGTGACTTC | 252: CAATCCCAACCGTAACAGGC | |
| NDUFV1 | D11S2245E | EST | GDB: 445895 | | 253: CTTGATCTCGCCCAGAAC | 254: GCTCGCTGAAGGATGAAGAC | NDUFV1 |
| AFMb032zg5 | D11S4138 | MSAT | GDB: 609546 | 0.19 | 255: GAATCGCTTGAACCCAG | 256: CCAGGTGTCTTAACGG | |
| AFMa059xg9 | D11S4196 | MSAT | GDB: 614025 | 0.2 | 257: GAACGTTNTCATGTAGGCGT | 258: TAATGGTCGCTGTCCC | |
| Cda17c12 | D11S2288E | EST | GDB: 445842 | 0.158 | 259: AGGGAAAATGTATGTGGGAG | 260: GCAGTGTGTGAAGGCAGG | |

TABLE 3-continued

HBM STS Table

| STS Name | Locus Name | Type | GDB Access. | Size (kb) | SEQ ID NO: Forward Primer | SEQ ID NO: Reverse Primer | Gene Name |
|---|---|---|---|---|---|---|---|
| SHGC-1364 | D11S951E | EST | GDB: 4562765 | 0.137 | 261: AGTGGACAAAATGAGGAAAACAGG | 262: CCAACACAGTTTGCTCACATGCC | |
| RH17410 | | EST | GDB: 4571587 | 0.126 | 263: TGACATCTTTGCATTATGGC | 264: AGTTATCCCACCTGATACCG | |
| RH17414 | | EST | GDB: 4571595 | 0.121 | 265: AGCTCTTGCTTCTCAGTCCA | 266: CAAAAGTTGTTTCTGTGTTTGTTC | |
| RH17770 | | EST | GDB: 4572301 | 0.267 | 267: GCCTCTCAAAGTAGTTGGAACC | 268: TGTGTATCCATAGTGCAAAACAG | |
| SEA | | EST | GDB: 4590169 | 0.13 | 269: CTCAAGGCCAGGCATCACT | 270: GGACTCTTCCATGCCAGTG | S13 avian erythroblastosis oncogene homolog |
| RH10689 | | EST | GDB: 4583460 | 0.107 | 271: AATGATGATCTCAACTCTG | 272: ACTGAAGAACTCTTGTCCT | |
| TIGR-A006P20 | | EST | GDB: 4587692 | 0.238 | 273: GACATCTGTTAGTCTCATAATTC | 274: GGTAACAGTGTCTTGCTT | |
| TIGR-A007D15 | | Gene | GDB: 4588398 | 0.24 | 275: CTATGTACAAAACAGGAAGAG | 276: ATCCTAGTTTCCTCTCCTT | Menin gene (MEN1) |
| TIGR-A008B14 | | EST | GDB: 4588882 | 0.141 | 277: GTAAATGAGAACAGACAAATGA | 278: CTATTGGATGTGATATGTTATGG | |
| TIGR-A008K11 | | EST | GDB: 4589094 | 0.203 | 279: AAGTAGAAACAAAATGAGGGAC | 280: CCTACCCCAAGGTAACAG | |
| TIGR-A008P15 | | EST | GDB: 4589662 | 0.182 | 281: ACTTCCTATAAATGGAGGTGAG | 282: GAGGAGCTTCAAGAGAA | |
| TIGR-A008T11 | | EST | GDB: 4589278 | 0.138 | 283: CATACTCCCTAGACTCAAGGAATC | 284: GAATGATGTACATGAATTCTTTG | |
| TIGR-A008U48 | | EST | GDB: 4589384 | 0.107 | 285: GTGTTGAGGAGAAAAGCACT | 286: CTCCCAGTAGTCACATTCC | |
| TIGR-A008X45 | | EST | GDB: 4589838 | 0.242 | 287: CAAGTAGTACAAATAACTTAAGCCG | 288: CAAGACCCTATCTCTACAAAAAC | |
| SHGC-11839 | D11S4611 | Gene | GDB: 740339 | 0.151 | 289: TTTATTAGAAGTGACTCTTGGCCC | 290: GACTACCTGCCCTCAGCTTG | Folate receptor 2 (FBP2) |
| NIB1242 | D11S4929E | EST | GDB: 3888276 | 0.149 | 291: TTCTCATGTACAAAGCGGTC | 292: CCACTGGCTTCTCTCTTTTT | cGMP-stimulated 3', 5'-cyclic nucleotide phosphodiesterase PDE2A3 (PDE2A) |
| SHGC-13599 | D22S1553 | Gene | GDB: 737558 | 0.147 | 293: CACCAGAAGGTTGGGGTG | 294: ACTATTACGACATGAACGCGG | Macrophage Migration Inhibitory factor |
| SHGC-11867 | D11S4331 | Gene | GDB: 674684 | 0.14 | 295: CTCATGCTGGATGATGACCCC | 296: TTGCCTTTCTTGAAACTTAATTCC | P2U Purinoceptor |
| SHGC-15349 | D12S2124 | EST | GDB: 740819 | 0.141 | 297: TCACAGCCTTCCAGTCAGGG | 298: ACATGCTGTGGCCACCATG | |
| BdaB4s05 | D11S2235E | EST | GDB: 445662 | 0.095 | 299: CCTGAGCTACTGCCACAG | 300: CCCTGACTTGGACAGTGTCC | |

TABLE 3-continued

HBM STS Table

| STS Name | Locus Name | Type | GDB Access. | Size (kb) | SEQ ID NO: Forward Primer | SEQ ID NO: Reverse Primer | Gene Name |
|---|---|---|---|---|---|---|---|
| BdaB9d07 | D11S2238E | EST | GDB: 445874 | 0.09 | 301: TCAGAGTCACTCCTGCCC | 302: CAAATTCAAGCTCATCCAGACC | |
| foir1 | | Gene | GDB: 197840 | 0.3 | 303: CGGCATTTCATCCAGGAC | 304: GGTGTAGGAGGTGCGACAAT | Folate receptor 2 (FBP2) |
| NIB1738 | D11S4284 | EST | GDB: 626260 | 0.173 | 305: TTCCATTATTGAGCACCTG | 306: CTTAAGCCACTGTGTTTTGG | |
| WI-7351 | D11S4433 | Gene | GDB: 679143 | 0.324 | 307: CCTTCCTACACCTACACCTGCAAAAGC | 308: TGGAAGAACCCCAGAGGAC | Folate receptor 3 (FBP3) |
| WI-14325 | | EST | GDB: 4578507 | 0.132 | 309: AAAGCACAAAAGTAACAGCAACA | 310: GTGTGTGGGCCACAAATATTG | |
| WI-15192 | | EST | GDB: 4575806 | 0.15 | 311: AGAGCACCTTTCCTCAGCAC | 312: AGAATCTCATCACAGGGGCG | |
| WI-17872 | | EST | GDB: 4577492 | 0.141 | 313: AAAAAGGACAGTGTCTAAAATTTGA | 314: AATTGTTTTTGTTTGTTTTTGAGT | |
| SHGC-30732 | | EST | GDB: 4587830 | 0.105 | 315: GATTTAGGGAGTAACAGTGCGG | 316: GGGGACAAATTATACTTTATTCAGG | |
| stSG4288 | | EST | GDB: 4566057 | 0.123 | 317: CCATCATCATATTGTGTGACC | 318: TGGCTGCCCAAGAAGAAG | |
| WI-13814 | | EST | GDB: 4579290 | 0.15 | 319: TTAAGATGCCATTAAACTCATGAC | 320: CCAAGGAGATGACCAAGTGG | (DRES9) |
| WI-14122 | | Gene | GDB: 4576114 | 0.126 | 321: CCATCTCTTTTATCAGGGTTGG | 322: CTCTGTGCAAGTAAGCATCTTACA | Human VEGF related factor isoform VRF186 precursor (VRF) |
| 2729/2730 | D11S4057 | EST | GDB: 5966509 | 0.118 | 323: CGACTGTGTATTTCCACAG | 324: AGAAGCCCATATCAATGCAC | |
| SHGC-31329 | | EST | GDB: 4567386 | 0.15 | 325: AGCTTAAAGTAGGACAACACCATGG | 326: GGATGCTTCACTCCAGAAG | |
| SGC33858 | | EST | GDB: 4578800 | 0.127 | 327: TGTTGTTTATTTCCACCTGCC | 328: AGAGTGGCTGCAGGCCAG | |
| WI-12191 | | EST | GDB: 1222206 | 0.15 | 329: TTTTTTTTTTTTTACACGAATTTGAGG | 330: TGAGGAAGTAAAAACAGTCATC | |
| WI-13701 | | EST | GDB: 4574892 | 0.15 | 331: ATGAAATCTTAAGCAGAATCCCA | 332: CACAGAGTCCCAGGGTCTGT | |
| WI-14069 | | EST | GDB: 4584373 | 0.15 | 333: AAAGGCCTTTATTTATCTCTCTG | 334: GCCTCAGAGCTGTGGGT | |
| WI-14272 | | EST | GDB: 4578525 | 0.125 | 335: GCTTCTAAGTCTTAGAGTGCCAG | 336: AGCCCACAGTCAGCTACC | |
| WI-17347 | | EST | GDB: 4578523 | 0.127 | 337: TTGGTTAAATGATGCCAG | 338: TGGTCCCACTCACATCCC | |
| stSG1581 | | EST | GDB: 4584415 | 0.215 | 339: ACACAGCATGCAGGGAGAG | 340: ATCCCTGTGCTTAGGTGG | |
| stSG1938 | | EST | GDB: 4584568 | 0.137 | 341: GATGGAAGTAGCTCTCTCGG | 342: GGAAGGCCAGCAAGTACTACC | |
| stSG2759 | | EST | GDB: 4565137 | 0.141 | 343: CCGGTGCTTGAAAGATG | 344: GAAGTGTCTCTGTTGGGGGA | |

TABLE 3-continued

HBM STS Table

| STS Name | Locus Name | Type | GDB Access. | Size (kb) | SEQ ID NO: Forward Primer | SEQ ID NO: Reverse Primer | Gene Name |
|---|---|---|---|---|---|---|---|
| RH97 | | EST | GDB: 4559690 | 0.17 | 345: TTACAGGCATGAGTCACTACGC | 346: ACCACTCTCACAGCCCTTACA | |
| stSG4794 | | EST | GDB: 4573113 | 0.141 | 347: CCCTCCCTCCACACACAC | 348: GCTCACTGAACTTTCAGGGC | |
| stSG4957 | | EST | GDB: 4569051 | 0.171 | 349: AGATACCGGCAAAACACTGG | 350: GTTGAATATAGAGCAGGGCCC | |
| stSG4974 | | EST | GDB: 4569063 | 0.166 | 351: TTCTGAGGTCAGGGCTGTCT | 352: AGCTTGGAAAATCTCGTGTCA | |
| stSG8144 | | EST | GDB: 4573137 | 0.17 | 353: ACTCAGTCCCTCCCACCC | 354: TCCTCTCACTCCTTCCCAGA | |
| stSG9275 | | EST | GDB: 4589999 | 0.19 | 355: GTGATCACGGCTCAACCTG | 356: TGGAGGACTGCTTGAGCC | |
| SHGC-10667 | D11S4583 | Gene | GDB: 740246 | 0.277 | 357: CTGCAGCTGCCTCAGTTTC | 358: TCAAAAGTGCTGGTGACAGC | Human protein kinase (MLK-3) |
| SHGC-11930 | | Gene | GDB: 1231223 | 0.21 | 359: ATTTCAGAGAGCCAGCTCAAA | 360: CTTTAATGTTGTGATGACACAAAGC | FGF3 |
| SHGC-32786 | | EST | GDB: 4567878 | 0.125 | 361: GATCATGCACTGTTGACCAC | 362: TACATTTGAAACATTTAAAACCTGA | |
| FKBP2 | | Gene | | 0.064 | 363: AACTGAGGCTGTAACCAGACTGGGA | 364: TGGAACAGTCTCGTCCTGATGG | FK506-Binding Protein Precursor (FKBP-13) |
| WI-13116 | | EST | GDB: 4585095 | 0.202 | 365: TTATCCCTTTATTGTTTCTCCTTTG | 366: TGGTCACCTGTATTATTGCTAGG | |
| MDU1 | | Gene | GDB: 4590064 | 0.859 | 367: TCTTCAAAGCCTCTGCAGTACC | 368: CTCATCTCCAACCTGTCTAACC | 4F2 Cell-Surface Antigen Heavy Chain (4F2HC) |
| S453 | D11S579 | STS | GDB: 196276 | 0.108 | 369: GTGGCTGCAGCTAATGTAAGACAC | 370: CAGCAGAGACAATGGCGTAAGTCC | |
| STS1-cSRL-112a11 | D11S3866 | STS | GDB: 547681 | 0.135 | 371: CTGATTGAGAACCAGAACAG | 372: TAAAGCCCTATAACCTCTCC | |
| STS1-cSRL-44a3 | D11S3830 | STS | GDB: 547609 | 0.118 | 373: TAGTAAGGGACCTTCACCAG | 374: AGATGTTTGGTATGACTTGG | |
| STS1-cSRL-31b12 | D11S2439 | STS | GDB: 459728 | 0.123 | 375: GATGATTAAACTCTCCTGGC | 376: GAGACAGTAAGCACTCATG | |
| cSRL-419 | D11S1137 | STS | GDB: 197824 | 0.196 | 377: GAGGTGGTGGGCACCTGTA | 378: AGAGGGAGGAGGAACACACCTT | Folate receptor 2 (FBP2) |
| SHGC-10323 | D11S4351 | Gene | GDB: 676135 | 0.141 | 379: GACCAGAGTCTGCCCAGAAG | 380: TCCCCAGCTCTATCCCAAC | Collagen binding protein 2, colligin-2 gene (CBP2) |
| WI-9219 | | Gene | GDB: 678179 | 0.1 | 381: GGAGGGATGGACAAGTCTGA | 382: GTCCAGCTCGCTGACTATCC | Retinal outer segment membrane protein 1, ROM1 |

TABLE 3-continued

HBM STS Table

| STS Name | Locus Name | Type | GDB Access. | Size (kb) | SEQ ID NO: Forward Primer | SEQ ID NO: Reverse Primer | Gene Name |
|---|---|---|---|---|---|---|---|
| GTC.ZNF | | Gene | | 0.172 | 383: TCAAAACACAGTCATCTCCA | 384: GCAAAGGCTTTACCATATTG | ZNF126 |
| AFMa152yh1 | D11S4087 | MSAT | GDB: 603797 | 0.158 | 385: GCTCAGCACCCCCATT | 386: TCCCTGCTCGGGAAAC | |
| AFMb331zh5 | D11S4162 | MSAT | GDB: 611241 | 0.263 | 387: GTTCTCCAGAGAGACAGCAC | 388: GAGAGCAACACTATTGCCC | |
| AFMb038yb9 | D11S4139 | MSAT | GDB: 609621 | 0.151 | 389: TATAGACTTCAGCCCTGCTGC | 390: CCTCTGTAGGATGCAGTTGG | |
| AFM212xa3 | D11S1314 | MSAT | GDB: 199292 | 0.209 | 391: TTGCTACGCACTCCTCTACT | 392: GTGAAGGCAGGAAATGTGAC | |
| WI-18813 | | EST | | 0.13 | 393: ATCCTAGACCAGAGAGAGCCC | 394: CTCCCCCTGGTCCAGTTATT | Serine/threonine kinase |
| WI-19549 | | EST | | 0.252 | 395: AACTTTCATTTGCCAAGGGA | 396: AGCAGATCGCTCTTGCGAT | |
| WI-20154 | | EST | | 0.25 | 397: bACAGTTGTCATCGTAGGCA | 398: AAAAGTATGAATGGGATGGAGC | |
| WI-22393 | | EST | GDB: 4583084 | 0.142 | 399: GTGCAGGTGGCGTTTATTTT | 400: CCCTATATCTCCGTGTCTCC | DRES9 |
| WI-7587 | | EST | GDB: 1223732 | 0.274 | 401: GCTCTAGTGGGAAACCTCAGG | 402: GAATTCCAGGCTCTTGCTTG | Ultra high-sulphur keratin protein (KRN1) |
| EST455579 | | EST | | 0.273 | 403: GGTTTGTCTCAAAGGCAAA | 404: CCAGTACATGGTGGTCACCA | |
| WI-21134 | | EST | | 0.293 | 405: GCTGCCTTGGAATTTCTGTT | 406: GTGCTGTGGTGGGGAAAG | Fas-associating death domain-containing protein, FADD |
| WI-21698 | | EST | | 0.25 | 407: ATTCAAGCTCATCCAGACCC | 408: GGACTGGCCCTTTGAAACTC | |
| SHGC-7373 | D11S4567 | STS | GDB: 740192 | 0.225 | 409: ATATTGACCGTGCACAAATACG | 410: AGACCTGGGAAAAGTGGAGAA | |
| SHGC-38533 | | STS | | 0.125 | 411: ATTGGCAGTGGAAAATGCTT | 412: TTAATCTTTTGTCAACTTCCTGATT | |
| ARIX | | Gene | GDB: 6262613 | 0.242 | 413: tctgtcctccttcaccggaagc | 414: ggataaagaaactccgtctctgctgtaga | Arix homeo-domain protein, neuroendocrine specific, tx factor |
| CLCI.PCR | | Gene | | | 415: TCAGGGCCTGTGTTGCCGCACTCTG | 416: AGCGATGTAAAGGGTACCAGTGCCGAGG | Chloride channel current inducer,ICLM gene |
| B188N21-HL | | STS | | | 417: AGGCATGCAAGCTTCTTA | 418: CCGGGAGAGACATCTAT | |
| B234C17-HR | | STS | | | 419: TGGTAAGCACAGAAAATGC | 420: AATGGATGGGGATTATT | |
| B235G10-HR | | STS | | | 421: CTGGACGTTATGTCTGCC | 422: AGAGGCCCAGTCACAGAT | |
| B247F23-HR | | STS | | | 423: ATCACTCTGAACTGCCACT | 424: CCCTTCTGTTTTTTCTGTTTT | |

TABLE 3-continued

HBM STS Table

| STS Name | Locus Name | Type | GDB Access. | Size (kb) | SEQ ID NO: Forward Primer | SEQ ID NO: Reverse Primer | Gene Name |
|---|---|---|---|---|---|---|---|
| B337H24-HL | | STS | | | 425: CAAGCTTTGAAGGAAGAG | 426: TAGGACGTTAAGTGAGGAC | |
| B337L5-HL | | STS | | | 427: GCTCTGCAGTGGGTAAAA | 428: ACTCTCCAAGACTGTGCG | |
| B382N10-HR | | STS | | | 429: CCCTTTCTGAGGCAAGAT | 430: GACCACCTGGAGAGAAC | |
| B1211-HR | | STS | | | 431: CGCTATGAGTCCCATCTG | 432: GATCAGTGCAATGAAGG | |
| B180D17-HR | | STS | | | 433: TTGAGTACACCGGGGTGAC | 434: CGCAGGACTGAAAGATGA | |
| B238E6-HR | | STS | | | 435: ACCTGTCTCCTCTCCTGG | 436: TGCTTTTCTTCTGTGGGA | |
| B278E22-HR | | STS | | | 437: ATGACCAGCAAGCATTGT | 438: GTACTGGGATTACAGGCG | |
| B312F21-HR | | STS | | | 439: GCAGAAGGTCCTTTGAT | 440: TTTGCAGATTCATGCTT | |
| B337H24-HR | | STS | | | 441: CGACATTCTTTTCTGGAGG | 442: ACCTTTGCATGTTGGTTTT | |
| B358H9-HR | | STS | | | 443: GACATTTTCCTTCCTTCC | 444: TGCTTTGCTTTTCTTCTG | |
| B148N18-HL | | STS | | | 445: ACAGCTCCAGAGAGAAGGA | 446: GCAGTCACTTGAAACCAGA | |
| B172N12-HL | | STS | | | 447: AGGCATCAAGCTTTCCTT | 448: GGTTTAGAGAACCGAGCC | |
| B172N12-HR | | STS | | | 449: GTGGTGCTGCAAGTTACC | 450: GGAATCCCTTTCTTTTCCA | |
| B215J11-HR | | STS | | | 451: GACCATTTGTTACGCAGC | 452: GATGGGTGTGAATGAACAA | |
| B223E5-HR | | STS | | | 453: CTCAAGCTTCTCTGTTCATGC | 454: GCTGTGAGTGTCTTGGCT | |
| B312B3-HR | | STS | | | 455: TACAGAAAACCGCAGCTC | 456: GCCACCAAAGAAAGATT | |
| B328G19-HL | | STS | | | 457: AAAAGGAGGGAATCATGG | 458: TCACTTAGCAGGAGGCAG | |
| B328G19-HR | | STS | | | 459: CTGAGCATCCGATGAGAC | 460: GTGCAAATGAGCAGCTT | |
| B329I10-HL | | STS | | | 461: TCTAACCCCTTACTGGGC | 462: TCCTCAAACTGGGAATGA | |
| B329I10-HR | | STS | | | 463: TTTACACAGGACCAGGA | 464: ATCTCCCCACTCAGAAG | |
| B388G19-HL | | STS | | | 465: GTCCACGGGCTTTATTCT | 466: TGAGCATAAATTTCATTAGCTG | |
| B388G19-HR | | STS | | | 467: GGAAGAGCAAAATAAATCCA | 468: GGTGCACAGAATTGTTCAT | |
| B36F16-HL | | STS | | | 469: AGCCACGCTTATTCATGG | 470: GTAACACCAGCAGGGACA | |

TABLE 3-continued

HBM STS Table

| STS Name | Locus Name | Type | GDB Access. | Size (kb) | SEQ ID NO: Forward Primer | SEQ ID NO: Reverse Primer | Gene Name |
|---|---|---|---|---|---|---|---|
| B250K11-HR | | STS | | | 471: TCCTGCTGCATTATGGAT | 472: GGGGGTGAGAAGTAGGAA | |
| B338D17-HR | | STS | | | 473: ATGGGGATTAAATACGGG | 474: AGCTAGCATTGGGCTCTT | |
| B268I23-HL | | STS | | | 475: CTGAGGAAGAAGAGGCTGG | 476: CGCCTTACAAGGCAAGTA | |
| B268I23-HR | | STS | | | 477: AGGATGCTTGCTAGGGTT | 478: CACAAGTGTCTGGAAGGC | |
| B371E15-HR | | STS | | | 479: GGTCTCAGGAGCCCTTTA | 480: ACATGCCACTCTTCTCACTAA | |
| B312F21-HL | | STS | | | 481: ACTTAACCAAGGATGGGG | 482: CAACCCACGAGCATAAGA | |
| B338D17-HL | | STS | | | 483: TAGGCTCTGCACTCTTGG | 484: ACCCACGGAGTCTCTC | |
| B369H19-HL | | STS | | | 485: TAAAGGCGGTGAAGTGAG | 486: CTACCGCTCTCCTAGGCT | |
| B369H19-HR | | STS | | | 487: TGGGGCCAGATAATTCTT | 488: CTGGTGTTTGGTGGTGTT | |
| B444M11-HR | | STS | | | 489: AAGGAAGAGAGTCACCAGG | 490: CACAAATTCCATTTCCCA | |
| B269L23-HL | | STS | | | 491: TCAATAGGTGATCCAACATTT | 492: AAAGTCCCACAAAGGGTC | |
| B250K11-HL | | STS | | | 493: GGGTAGGGGGATCTTTTT | 494: TGTGGAACATTCATTGGC | |
| B269L23-HR | | STS | | | 495: GTCCTGGGAAAGATGGAA | 496: TCAAAGCGTCTCCCATAA | |
| B384H4-HL | | STS | | | 497: TCTTTGCGTGTACTTGGC | 498: TGGGAGGTCAGAGTGATG | |
| B364H4-HR | | STS | | | 499: GGACAGTGTATGTGTTGGG | 500: AGGCAGCTGTTTTTGTGA | |
| B47303-HR | | STS | | | 501: CTTCTTGAGTCCCGTGTG | 502: CAACCGAGAATCCTCTAGC | |
| B180D17-HL | | STS | | | 503: GCTGGGAGAGAATCACAA | 504: GCTTTGCAGAAGAGACCA | |
| B200E21-HL | | STS | | | 505: ACGCTGTCAGGTCACACT | 506: GGAGGATGCTCAGGTGAT | |
| B200E21-HR | | STS | | | 507: TAGGGGGATCTTTTTCCA | 508: GAGCAATTTGAAAAGCCA | |
| B14L15-HR | | STS | | | 509: ATGGTCCAGCTCCTCTGT | 510: ATAGAGACCCCATCTCC | |
| B442P6-HR | | STS | | | 511: AACATTGCTGTTAGCCCA | 512: GCAATCGAAACAGCATTC | |
| B188N21-HR | | STS | | | 513: ATGAGTTGGCAGCTGAAG | 514: AATGAAGTCTTGCCTCC | |
| GTC-ARRB1 | | Gene | | 0.067 | 515: GAGGAGAAGATCCAAAGCG | 516: TCTCTGGGCATACTGAACC | Beta-arrestin-1 |
| B508A5-HL | | STS | | | 517: CTGAGCTTTTGGCACTGT | 518: CTGCTAGTGACAGCAGG | |

TABLE 3-continued

HBM STS Table

| STS Name | Locus Name | Type | GDB Access. | Size (kb) | SEQ ID NO: Forward Primer | SEQ ID NO: Reverse Primer | Gene Name |
|---|---|---|---|---|---|---|---|
| B38F16-HR | | STS | | | 519: TGTATGAGTCTGGAGGGTGT | 520: ACACCTGGCTGAGGAAAT | |
| B117N18-HL | | STS | | | 521: GCAGGGGACGTGATAATA | 522: TTTTGCTTCCTACCATGC | |
| B14L15-HL | | STS | | | 523: AAAATTGTGAGCACCTCC | 524: TTTATATTTAAAGTGGCTTTGTT | |
| B21K22-HL | | STS | | | 525: GTGCAAAGCCCACAGTAT | 526: AGGAAAATGCAAGAGACAG | |
| B21K22-HR | | STS | | | 527: CCACTGAATTGCATACTTTG | 528: TCTGGGTCCAGTCTGCTA | |
| B223E5-HL | | STS | | | 529: AGATTTTGGGAGTCAGG | 530: GCGCTCAAGCAATTCTC | |
| B278E22-HL | | STS | | | 531: CAAGCCCCAAAGTAGTCA | 532: GAATCATCCAATCCACGA | |
| B444M11-HL | | STS | | | 533: AGCCTCCAGGTGACTACC | 534: GAAGGACATGGTCAGCAG | |
| B543O19-HR | | STS | | | 535: ATGCTTTCAGCATTTTCG | 536: TGATCCGTGGTAGGGTTA | |
| B117N18-HR | | STS | | | 537: GTCGGATTGGTTTCACAA | 538: TTTTATGGGAATTTCAGCC | |
| B543O19-HL | | STS | | | 539: TTTGGAAAGAACAGAAATGT | 540: GGCTAGTCTTTCCTGAACC | |
| B442P6-HL | | STS | | | 541: CCTTAATGCCCCTGATTC | 542: GCGTTTACAAGCTGAGGA | |
| B387H4-HR | | STS | | | 543: TCAAGCTTGCTTTCTCAA | 544: GTAGCCCAGCAAGTGTCT | |
| B250E21-HR | | STS | | | 545: CCTGGCTGGAGATAGGAT | 546: CTTCCCCTCTGCCTATGT | |
| B250E21-HL | | STS | | | 547: GGCACGTACTTCCTACCA | 548: GGTGCTTCTTACAGGCAA | |
| B248C16-HR | | STS | | | 549: ACCCAGGCTGGTGTGT | 550: ACTGAGTTAATTATCACTCCCCT | |
| B248C16-HL | | STS | | | 551: GATGCATTTTGCTTCACC | 552: TCTGCTTTTAGAGCTGTTAGC | |
| B160D8-HR | | STS | | | 553: TCAAGCTTCAAAGAGCAGA | 554: GGAGTACATCCCAGGACC | |
| B539L7-HR | | STS | | | 555: TGGTGCTTTTAAATCCAGA | 556: CTCCCTTACTTACTTGCATTG | |
| B47303-HL | | STS | | | 557: TCTTCTCCCAGGAATCT | 558: TTTATGTCCCCTGAGCAC | |
| AFMa190xd9 | D11S4095 | STS | GDB: 606064 | 0.193 | 559: TCCCCTGGCTATCTTGAATC | 560: CTTGACTGGGTCCACG | |
| ARRB1(2) | | STS | | | 561: CGAGACGCCAGTAGATACCA | 562: CATCCTCCATGCCTTTCAGT | |
| ARRB1(1) | | STS | | | 563: AGTTCCAGAGAACGAGACGC | 564: CTTGTCATCCTCCATGCCTT | |

TABLE 3-continued

HBM STS Table

| STS Name | Locus Name | Type | GDB Access. | Size (kb) | SEQ ID NO: Forward Primer | SEQ ID NO: Reverse Primer | Gene Name |
|---|---|---|---|---|---|---|---|
| P102F3S | | STS | GDB: 6054145 | | 565: GAGCGTGAGAGAGGTTGAGGAG | 566: AAACAAACTCCAGACGCGACC | |
| N172A | | STS | GDB: 6054146 | 0.208 | 567: CTGAACCACTACCTGTATGACCTG | 568: CTAACTACTTACCTCCTACAGGGCCC | |
| N60A | | STS | GDB: 6054147 | 0.23 | 569: GAAGCATTTCAATACTTTAACTG | 570: CCACTCCAGTGCACCCAATC | |
| cCI11-44A | | STS | GDB: 6054148 | 0.239 | 571: CTTCCCTGGCCACTCTGAC | 572: GGTTTACCTTTGAATCCCAGC | |
| CN1677-2A | | STS | GDB: 6054149 | 0.271 | 573: TGAGGATGAATGAGCACATAGG | 574: TTTGTGTCCATTGAGTAGGC | |
| cCI11-524B | | STS | GDB: 6054150 | 0.221 | 575: AGGGGAAGGAATGTGCTTGG | 576: TTCGGCTGAGCGGGCAGTGT | |
| P117F3T | | STS | GDB: 6054151 | 0.168 | 577: ATTGAAGGTGCTCCAAAGAATGCTGCAGC | 578: AGAACGTCAACATATCTTTTGGGGACAC | |
| ARRB1(3) | | Gene | | | 579: TTGTATTTGAGGACTTTGCTCG | 580: CGGTACCATCCTCCTCTTCC | |
| B215J11-HL | | STS | | 0.122 | 581: TTTTTGCCTCATCTATGCCC | 582: GGGTGACAGAGCAAGACTCC | |
| B317G1-HR | | STS | | | 583: TTGCTCAAGTTCTCCTGG | 584: ACCTTGTTTTGAGGGGAG | |
| B317G1-HL | | STS | | | 585: CTTGGCTATTTGGACAGC | 586: GGGCATTACTCACTTGC | |
| B282J18-HR | | STS | | | 587: CTGTGTCAGTTGTCAGGG | 588: TGGAATTGTTGTGTCTTGG | |
| B10A18-HL | | STS | | | 589: CCAGTTCCACTGGATGTT | 590: ATGGGCTGTGTTTCTCAA | |
| B10A18-HR | | STS | | | 591: CTGCCTATCCCTGGACT | 592: AGTTTGTCCCTAGTGCCC | |
| B527D12-HL | | STS | | | 593: CAACACGTCTCGACATCCAT | 594: GGATAGTGCACACCCA | |
| B372J11-HR | | STS | | | 595: TGGGTGGTACTATTGTTCCCAT | 596: AGTTCCCAGCCCCCCTTACCAG | |
| B372J11-HL | | STS | | | 597: GGCCACTATCATCCCTGTGT | 598: TTTCACATGGGAAGAACACG | |
| B37E17-HR(GS) | | STS | | | 599: ACAGTGACACTAGGGACGGG | 600: TGCCAGGATGGAGATAACAA | |
| B37E17-HL(GS) | | STS | | | 601: CCTGTGGCACACATATCACC | 602: ACAACCAAGAATGGAGCCAC | |
| B34F22-HR(GS) | | STS | | | 603: TGCTGTGTAACAAGTCCCCA | 604: TGAACGGAGGACCTACCAAG | |
| B34F22-HL(GS) | | STS | | | 605: GCAGGGTCCGACTCACTAAG | 606: GCTGTGAGTTCCCTTTACGC | |
| B648P22-HR1 | | STS | | | 607: ACAGTGGGACAAAGACAGG | 608: TACAGGGCACCTCCCAGTAG | |
| B82A4-HR2 | | STS | | | 609: TCTTCTGTTAAGGTTTCCCCC | 610: TGTCTCAAACCTCCCTCTGC | |
| B648P22-HL | | STS | | | 611: AACATATTTCCTCCCCAGCC | 612: CAGTCCCAGCCAATGAGAAC | |

TABLE 3-continued

HBM STS Table

| STS Name | Locus Name | Type | GDB Access. | Size (kb) | SEQ ID NO: Forward Primer | SEQ ID NO: Reverse Primer | Gene Name |
|---|---|---|---|---|---|---|---|
| B82L11-HL(GS) | | STS | | | 613: CTCCTCTGCATGGGAGAATC | 614: AGACCTGGGACCAGTCTGTG | |
| B86J13-HL(GS) | | STS | | | 615: GGGAGACGACGTCACAAGAT | 616: TGATGTTGGGAAGATGGTGA | |
| 144A24-HL | | STS | | | 617: CAGGCATCTTCTATGTGCCA | 618: GGGAGGCACAAGTTCTTTCA | |
| B82L11-HR(GS) | | STS | | | 619: ACTTCGTGGCACTGAGTGTG | 620: CCTTTCTTACGGATGAGGCA | |
| B86J13-HR(GS) | | STS | | | 621: GGCTGCTGAGCTCTTCTGAT | 622: TGGGTCTCTCTGCCTGACTT | |
| B82L11-HL2(GS) | | STS | | | 623: TCACCTACTTCCAGCTTCCG | 624: AGACCTGGGACCAGTCTGTG | |
| B82L11-HL3(GS) | | STS | | | 625: CTCCTCTGCATGGGAGAATC | 626: AATTCAGAGACCTGGGACC | |

Novel STSs were developed either from publicly available genomic sequence or from sequence-derived BAC insert ends. Primers were chosen using a script which automatically performs vector and repetitive sequence masking using Cross_match (P. Green, U. of Washington) and subsequent primer picking using Primer3 (Rozen, Skaletsky (1996, 1997). Primer3 is available at www.genome.wi.mit.edu/genome_software/other/primer3. html.

Polymerase chain reaction (PCR) conditions for each primer pair were initially optimized with respect to $MgCl_2$ concentration. The standard buffer was 10 mM Tris-HCl (pH 8.3), 50 mM KCl, $MgCl_2$, 0.2 mM each dNTP, 0.2 µM each primer, 2.7 ng/µl human DNA, 0.25 units of AmpliTaq (Perkin Elmer) and $MgCl_2$ concentrations of 1.0 mM, 1.5 mM, 2.0 mM or 2.4 mM. Cycling conditions included an initial denaturation at 94° C. for 2 minutes followed by 40 cycles at 94° C. for 15 seconds, 55° C. for 25 seconds, and 72° C. for 25 seconds followed by a final extension at 72° C. for 3 minutes. Depending on the results from the initial round of optimization the conditions were further optimized if necessary. Variables included increasing the annealing temperature to 58° C. or 60° C., increasing the cycle number to 42 and the annealing and extension times to 30 seconds, and using AmpliTaqGold (Perkin Elmer).

BAC clones (Kim et al., *Genomics*, 32:213-218 (1996), Shizuya et al., *Proc. Natl. Acad. Sci. USA*, 89:8794-8797 (1992)) containing STS markers of interest were obtained by PCR-based screening of DNA pools from a total human BAC library purchased from Research Genetics. DNA pools derived from library plates 1-596 were used corresponding to nine genomic equivalents of human DNA. The initial screening process involved PCR reactions of individual markers against superpools, i.e., a mixture of DNA derived from all BAC clones from eight 384-well library plates. For each positive superpool, plate (8), row (16) and column (24) pools were screened to identify a unique library address. PCR products were electrophoresed in 2% agarose gels (Sigma) containing 0.5 µg/ml ethidium bromide in 1× TBE at 150 volts for 45 min. The electrophoresis units used were the Model A3-1 systems from Owl Scientific Products. Typically, gels contained 10 tiers of lanes with 50 wells/tier. Molecular weight markers (100 bp ladder, Life Technologies, Bethesda, Md.) were loaded at both ends of the gel. Images of the gels were captured with a Kodak DC40 CCD camera and processed with Kodak 1D software. The gel data were exported as tab delimited text files; names of the files included information about the library screened, the gel image files and the marker screened. These data were automatically imported using a customized Perl script into Filemaker™ PRO (Claris Corp.) databases for data storage and analysis. In cases where incomplete or ambiguous clone address information was obtained, additional experiments were performed to recover a unique, complete library address.

Recovery of clonal BAC cultures from the library involved streaking out a sample from the library well onto LB agar (Maniatis et al., *Molecular Cloning: A Laboratory Manual.*, Cold Spring Harbor Laboratory, Cold Spring Harbor, N.Y. (1982)) containing 12.5 µg/ml chloramphenicol (Sigma). Two individual colonies and a portion of the initial streak quadrant were tested with appropriate STS markers by colony PCR for verification. Positive clones were stored in LB broth containing 12.5 µg/ml chloramphenicol and 15% glycerol at −70° C.

Several different types of DNA preparation methods were used for isolation of BAC DNA. The manual alkaline lysis miniprep protocol listed below (Maniatis et al., *Molecular Cloning: A Laboratory Manual*, Cold Spring Harbor Laboratory, Cold Spring Harbor, N.Y. (1982)) was successfully used for most applications, i.e., restriction mapping, CHEF gel analysis, FISH mapping, but was not successfully reproducible in endsequencing. The Autogen and Qiagen protocols were used specifically for BAC DNA preparation for endsequencing purposes.

Bacteria were grown in 15 ml Terrific Broth containing 12.5 µg/ml chloramphenicol in a 50 ml conical tube at 37° C. for 20 hrs with shaking at 300 rpm. The cultures were centrifuged in a Sorvall RT 6000 D at 3000 rpm (~1800 g) at 4° C. for 15 min. The supernatant was then aspirated as completely as possible. In some cases cell pellets were frozen at −20° C. at this step for up to 2 weeks. The pellet was then vortexed to homogenize the cells and minimize clumping. 250 µl of P1 solution (50 mM glucose, 15 mM Tris-HCl, pH 8, 10 mM EDTA, and 100 µg/ml RNase A) was added and the mixture pipetted up and down to mix. The mixture was then transferred to a 2 ml Eppendorf tube. 350 µl of P2 solution (0.2 N NaOH, 1% SDS) was then added, the mixture mixed gently and incubated for 5 mm. at room temperature. 350 µl of P3 solution (3 M KOAc, pH 5.5) was added and the mixture mixed gently until a white precipitate formed. The solution was incubated on ice for 5 min. and then centrifuged at 4° C. in a microfuge for 10 min. The supernatant was transferred carefully (avoiding the white precipitate) to a fresh 2 ml Eppendorf tube, and 0.9 ml of isopropanol was added, the solution mixed and left on ice for 5 min. The samples were centrifuged for 10 min., and the supernatant removed carefully. Pellets were washed in 70% ethanol and air dried for 5 min. Pellets were resuspended in 200 µl of TE8 (10 mM Tris-HCl, pH 8.0, 1.0 mM EDTA), and RNase A (Boehringer Mannheim) added to 100 µg/ml. Samples were incubated at 37° C. for 30 min., then precipitated by addition of $C_2H_3O_2Na.3H_2O$ to 0.5 M and 2 volumes of ethanol. Samples were centrifuged for 10 min., and the pellets washed with 70% ethanol followed by air drying and dissolving in 50 µl TE8. Typical yields for this DNA prep were 3-5 µg/15 ml bacterial culture. Ten to 15 µl were used for HindIII restriction analysis; 5 µl was used for NotI digestion and clone insert sizing by CHEF gel electrophoresis.

BACs were inoculated into 15 ml of 2×LB Broth containing 12.5 µg/ml chloramphenicol in a 50 ml conical tube. 4 tubes were inoculated for each clone. Cultures were grown overnight (~16 hr) at 37° C. with vigorous shaking (>300 rpm). Standard conditions for BAC DNA isolation were followed as recommended by the Autogen 740 manufacturer. 3 ml samples of culture were placed into Autogen tubes for a total of 60 ml or 20 tubes per clone. Samples were dissolved finally in 100 µl TE8 with 15 seconds of shaking as part of the Autogen protocol. After the Autogen protocol was finished DNA solutions were transferred from each individual tube and pooled into a 2 ml Eppendorf tube. Tubes with large amounts of debris (carry over from the pelleting debris step) were avoided. The tubes were then rinsed with 0.5 ml of TE8 successively and this solution added to the pooled material. DNA solutions were stored at 4° C.; clumping tended to occur upon freezing at −20° C. This DNA was either used directly for restriction mapping, CHEF gel analysis or FISH mapping or was further purified as described below for use in endsequencing reactions.

The volume of DNA solutions was adjusted to 2 ml with TE8, samples were then mixed gently and heated at 65° C. for 10 min. The DNA solutions were then centrifuged at 4° C. for 5 min. and the supernatants transferred to a 15 ml conical tube. The NaCl concentration was then adjusted to 0.75 M (~0.3 ml of 5 M NaCl to the 2 ml sample). The total volume was then adjusted to 6 ml with Qiagen column equilibration buffer (Buffer QBT). The supernatant containing the DNA was then applied to the column and allowed to enter by gravity flow. Columns were washed twice with 10 ml of Qiagen Buffer QC. Bound DNA was then eluted with four separate 1 ml aliquots of Buffer QF kept at 65° C. DNA was precipitated with 0.7 volumes of isopropanol (~2.8 ml). Each sample was then transferred to 4 individual 2.2 ml Eppendorf tubes and incubated at room temperature for 2 hr or overnight. Samples were centrifuged in a microfuge for 10 min. at 4° C. The supernatant was removed carefully and 1 ml of 70% ethanol was added. Samples were centrifuged again and because the DNA pellets were often loose at this stage, the supernatant removed carefully. Samples were centrifuged again to concentrate remaining liquid which was removed with a micropipet tip. DNA pellets were then dried in a desiccator for 10 min. 20 µl of sterile distilled and deionized $H_2O$ was added to each tube which was then placed at 4° C. overnight. The four 20 µl samples for each clone were pooled and the tubes rinsed with another 20 µl of sterile distilled and deionized $H_2O$ for a final volume of 100 µl. Samples were then heated at 65° C. for 5 min. and then mixed gently. Typical yields were 2-5 µg/60 ml culture as assessed by NotI digestion and comparison with uncut lambda DNA.

3 ml of LB Broth containing 12.5 µg/ml of chloramphenicol was dispensed into autoclaved Autogen tubes. A single tube was used for each clone. For inoculation, glycerol stocks were removed from −70° C. storage and placed on dry ice. A small portion of the glycerol stock was removed from the original tube with a sterile toothpick and transferred into the Autogen tube; the toothpick was left in the Autogen tube for at least two minutes before discarding. After inoculation the tubes were covered with tape making sure the seal was tight. When all samples were inoculated, the tube units were transferred into an Autogen rack holder and placed into a rotary shaker at 37° C. for 16-17 hours at 250 rpm. Following growth, standard conditions for BAC DNA preparation, as defined by the manufacturer, were used to program the Autogen. Samples were not dissolved in TE8 as part of the program and DNA pellets were left dry. When the program was complete, the tubes were removed from the output tray and 30 µl of sterile distilled and deionized $H_2O$ was added directly to the bottom of the tube. The tubes were then gently shaken for 2-5 seconds and then covered with parafilm and incubated at room temperature for 1-3 hours. DNA samples were then transferred to an Eppendorf tube and used either directly for sequencing or stored at 40° C. for later use.

VI. BAC Clone Characterization for Physical Mapping

DNA samples prepared either by manual alkaline lysis or the Autogen protocol were digested with HindIII for analysis of restriction fragment sizes. This data were used to compare the extent of overlap among clones. Typically 1-2 µg were used for each reaction. Reaction mixtures included: 1×Buffer 2 (New England Biolabs), 0.1 mg/ml bovine serum albumin (New England Biolabs), 50 µg/ml RNase A (Boehringer Mannheim), and 20 units of HindIII (New England Biolabs) in a final volume of 25 µl. Digestions were incubated at 37° C. for 4-6 hours. BAC DNA was also digested with NotI for estimation of insert size by CHEF gel analysis (see below). Reaction conditions were identical to those for HindIII except that 20 units of NotI were used. Six µl of 6× Ficoll loading buffer containing bromphenol blue and xylene cyanol was added prior to electrophoresis.

HindIII digests were analyzed on 0.6% agarose (Seakem, FMC Bioproducts) in 1×TBE containing 0.5 µg/ml ethidium bromide. Gels (20 cm×25 cm) were electrophoresed in a Model A4 electrophoresis unit (Owl Scientific) at 50 volts for 20-24 hrs. Molecular weight size markers included undigested lambda DNA, HindIII digested lambda DNA, and HaeIII digested_X174 DNA. Molecular weight markers were heated at 65° C. for 2 min. prior to loading the gel. Images were captured with a Kodak DC40 CCD camera and analyzed with Kodak 1D software.

NotI digests were analyzed on a CHEF DRII (BioRad) electrophoresis unit according to the manufacturer's recommendations. Briefly, 1% agarose gels (BioRad pulsed field grade) were prepared in 0.5×TBE, equilibrated for 30 minutes in the electrophoresis unit at 14° C., and electrophoresed at 6 volts/cm for 14 hrs with circulation. Switching times were ramped from 10 sec to 20 sec. Gels were stained after electrophoresis in 0.5 µg/ml ethidium bromide. Molecular weight markers included undigested lambda DNA, HindIII digested lambda DNA, lambda ladder PFG ladder, and low range PFG marker (all from New England Biolabs).

BAC DNA prepared either by the manual alkaline lysis or Autogen protocols were labeled for FISH analysis using a Bioprime labeling kit (BioRad) according to the manufacturer's recommendation with minor modifications. Approximately 200 ng of DNA was used for each 50 µl reaction. 3 µl were analyzed on a 2% agarose gel to determine the extent of labeling. Reactions were purified using a Sephadex G50 spin column prior to in situ hybridization. Metaphase FISH was performed as described (Ma et al., *Cytogenet. Cell Genet.*, 74:266-271 (1996)).

VII. BAC Endsequencing

The sequencing of BAC insert ends utilized DNA prepared by either of the two methods described above. The DYEnamic energy transfer primers and Dynamic Direct cycle sequencing kits from Amersham were used for sequencing reactions. Ready made sequencing mix including the M13-40 forward sequencing primer was used (Catalog #US79730) for the T7 BAC vector terminus; ready made sequencing mix (Catalog #US79530) was mixed with the M13-28 reverse sequencing primer (Catalog #US79339) for the SP6 BAC vector terminus. The sequencing reaction mixes included one of the four fluorescently labeled dye-primers, one of the four dideoxy termination mixes, dNTPs, reaction buffer, and Thermosequenase. For each BAC DNA sample, 3 µl of the BAC DNA sample was aliquoted to 4 PCR strip tubes. 2 µl of one of the four dye primer/termination mix combinations was then added to each of the four tubes. The tubes were then sealed and centrifuged briefly prior to PCR. Thermocycling conditions involved a 1 minute denaturation at 95° C., 15 second annealing at 45° C., and extension for 1 minute at 70° C. for 35 total cycles. After cycling the plates were centrifuged briefly to collect all the liquid to the bottom of the tubes. 5 µl of sterile distilled and deionized $H_2O$ was then added into each tube, the plates sealed and centrifuged briefly again. The four samples for each BAC were then pooled together. DNA was then precipitated by adding 1.5 µl of 7.5 M $NH_4OAc$ and 100 µl of −20° C. 100% ethanol to each tube. Samples were mixed by pipetting up and down once. The plates were then sealed and incubated on ice for 10 minutes. Plates were centrifuged in a table top Haraeus centrifuge at 4000 rpm (3,290 g) for 30 minutes at 4° C. to recover the DNA. The supernatant was removed and excess liquid blotted onto paper towels. Pellets were washed by adding 100 µl of −20° C. 70% ethanol into each tube and re-centrifuging at 4000 rpm (3,290 g) for 10 minutes at 4° C. The supernatant was removed and excess liquid again removed by blotting on a paper towel. Remaining traces of liquid were removed by placing the plates upside down over a paper towel and centrifuging only until the centrifuge reached 800 rpm. Samples were then air dried at room temperature for 30 min. Tubes were capped and stored dry at −20° C. until electrophoresis. Immediately prior to electrophoresis the DNA was dissolved in 1.5 µl of Amersham loading dye. Plates were then sealed and centrifuged at 2000 rpm (825 g). The plates were then vortexed on a plate shaker for 1-2 minutes. Samples were then recentrifuged at 2000 rpm (825 g) briefly. Samples were then heated at 65° C. for 2 min. and immediately placed on ice. Standard gel electrophoresis was performed on ABI 377 fluorescent sequencers according to the manufacturer's recommendation.

VIII. Sub-cloning and Sequencing of HBM BAC DNA

The physical map of the LRP5 gene region provides a set of BAC clones that contain within them the LRP5 gene and the HBM gene. DNA sequencing of several of the BACs from the region has been completed. The DNA sequence data is a unique reagent that includes data that one skilled in the art can use to identify the LRP5 gene and the HBM gene, or to prepare probes to identify the gene(s), or to identify DNA sequence polymorphisms that identify the gene(s).

BAC DNA was isolated according to one of two protocols, either a Qiagen purification of BAC DNA (Qiagen, Inc. as described in the product literature) or a manual purification which is a modification of the standard alkaline lysis/Cesium Chloride preparation of plasmid DNA (see e.g., Ausubel et al., *Current Protocols in Molecular Biology*, John Wiley & Sons (1997)). Briefly for the manual protocol, cells were pelleted, resuspended in GTE (50 mM glucose, 25 mM Tris-Cl (pH 8), 10 mM EDTA) and lysozyme (50 mg/ml solution), followed by NaOH/SDS (1% SDS/0.2 N NaOH) and then an ice-cold solution of 3 M KOAc (pH 4.5-4.8). RnaseA was added to the filtered supernatant, followed by Proteinase K and 20% SDS. The DNA was then precipitated with isopropanol, dried and resuspended in TE (10 mM Tris, 1 mM EDTA (pH 8.0)). The BAC DNA was further purified by Cesium Chloride density gradient centrifugation (Ausubel et al., *Current Protocols in Molecular Biology*, John Wiley & Sons (1997)).

Following isolation, the BAC DNA was sheared hydrodynamically using an HPLC (Hengen, *Trends in Biochem. Sci.*, 22:273-274 (1997)) to an insert size of 2000-3000 bp. After shearing, the DNA was concentrated and separated on a standard 1% agarose gel. A single fraction, corresponding to the approximate size, was excised from the gel and purified by electroelution (Sambrook et al., *Molecular Cloning: A Laboratory Manual*, Cold Spring Harbor Laboratory, Cold Spring, N.Y. (1989)).

The purified DNA fragments were then blunt-ended using T4 DNA polymerase. The blunt-ended DNA was then ligated to unique BstXI-linker adapters (SEQ ID NOS: 627-628) (5' GTCTTCACCACGGGG and 5' GTGGTGAAGAC in 100-1000 fold molar excess). These linkers were complimentary to the BstXI-cut pMPX vectors (constructed by the inventors), while the overhang was not self-complimentary. Therefore, the linkers would not concatemerize nor would the cut-vector religate itself easily. The linker-adapted inserts were separated from the unincorporated linkers on a 1% agarose gel and purified using GeneClean (BIO 101, Inc.). The linker-adapted insert was then ligated to a modified pBlueScript vector to construct a "shotgun" subclone library. The vector contained an out-of-frame lacZ gene at the cloning site which became in-frame in the event that an adapter-dimer is cloned, allowing these to be avoided by their blue-color.

All subsequent steps were based on sequencing by ABI377 automated DNA sequencing methods. Only major modifications to the protocols are highlighted. Briefly, the library was then transformed into DH5α competent cells (Life Technologies, Bethesda, Md., DH5α transformation protocol). It was assessed by plating onto antibiotic plates containing ampicillin and IPTG/Xgal. The plates were incubated overnight at 37° C. Successful transformants were then used for plating of clones and picking for sequencing. The cultures were grown overnight at 37°. DNA was purified using a silica bead DNA preparation (Ng et al., *Nucl. Acids Res.*, 24:5045-5047 (1996)) method. In this manner, 25 µg of DNA was obtained per clone.

These purified DNA samples were then sequenced using ABI dye-terminator chemistry. The ABI dye terminator sequence reads were run on ABI377 machines and the data was directly transferred to UNIX machines following lane tracking of the gels. All reads were assembled using PHRAP (P. Green, Abstracts of DOE Human Genome Program Contractor-Grantee Workshop V, Jan. 1996, p. 157) with default parameters and quality scores. The initial assembly was done at 6-fold coverage and yielded an average of 8-15 contigs. Following the initial assembly, missing mates (sequences from clones that only gave one strand reads) were identified and sequenced with ABI technology to allow the identification of additional overlapping contigs. Primers for walking were selected using a Genome Therapeutics program Pick_primer near the ends of the clones to facilitate gap closure. These walks were sequenced using the selected clones and primers. Data were reassembled with PHRAP into sequence contigs.

IX. Gene Identification by Computational Methods

Following assembly of the BAC sequences into contigs, the contigs were subjected to computational analyses to identify coding regions and regions bearing DNA sequence similarity to known genes. This protocol included the following steps.

1. Degap the contigs: the sequence contigs often contain symbols (denoted by a period symbol) that represent locations where the individual ABI sequence reads have insertions or deletions. Prior to automated computational analysis of the contigs, the periods were removed. The original data was maintained for future reference.

2. BAC vector sequences were "masked" within the sequence by using the program cross match (Phil Green, chimera.biotech.washington.edu/UWGC). Since the shotgun libraries construction detailed above leaves some BAC vector in the shotgun libraries, this program was used to compare the sequence of the BAC contigs to the BAC vector and to mask any vector sequence prior to subsequent steps. Masked sequences were marked by an "X" in the sequence files, and remained inert during subsequent analyses.

3. *E. coli* sequences contaminating the BAC sequences were masked by comparing the BAC contigs to the entire *E. coli* DNA sequence.

4. Repetitive elements known to be common in the human genome were masked using cross match. In this implementation of crossmatch, the BAC sequence was compared to a database of human repetitive elements (Jerzy Jerka, Genetic Information Research Institute, Palo Alto, Calif.). The masked repeats were marked by X and remained inert during subsequent analyses.

5. The location of exons within the sequence was predicted using the MZEF computer program (Zhang, *Proc. Natl. Acad. Sci.*, 94:565-568 (1997)).

6. The sequence was compared to the publicly available unigene database (National Center for Biotechnology Information, National Library of Medicine, 38A, 8N905, 8600 Rockville Pike, Bethesda, Md. 20894; www.ncbi.nlm.nih.gov) using the blastn2 algorithm (Altschul et al., *Nucl. Acids Res.*, 25:3389-3402 (1997)). The parameters for this search were: E=0.05, v=50, B=50 (where E is the expected probability score cutoff, V is the number of database entries returned in the reporting of the results, and B is the number of sequence alignments returned in the reporting of the results (Altschul et al., *J. Mol. Biol.*, 215:403-410 (1990)).

7. The sequence was translated into protein for all six reading frames, and the protein sequences were compared to a non-redundant protein database compiled from Genpept Swissprot PIR (National Center for Biotechnology Information, National Library of Medicine, 38A, 8N905, 8600 Rockville Pike, Bethesda, Md. 20894; www.ncbi.nlm.nih.gov). The parameters for this search were E=0.05, V=50, B=50, where E, V, and B are defined as above.

8. The BAC DNA sequence was compared to the database of the cDNA clones derived from direct selection experiments (described below) using blastn2 (Altschul et al., *Nucl. Acids. Res.*, 25:3389-3402 (1997)). The parameters for this search were E=0.05, V=250, B=250, where E, V, and B are defined as above.

9. The BAC sequence was compared to the sequences of all other BACs from the HBM region on chromosome 11q12-13 using blastn2 (Altschul et al., *Nucl. Acids. Res.*, 25:3389-3402 (1997)). The parameters for this search were E=0.05, V=50, B=50, where E, V, and B are defined as above.

10. The BAC sequence was compared to the sequences derived from the ends of BACs from the HBM region on chromosome 11q12-13 using blastn2 (Altschul et al., *Nucl. Acids. Res.*, 25:3389-3402 (1997)). The parameters for this search were E=0.05, V=50, B=50, where E, V, and B are defined as above.

11. The BAC sequence was compared to the Genbank database (National Center for Biotechnology Information, National Library of Medicine, 38A, 8N905, 8600 Rockville Pike, Bethesda, Md. 20894; www.ncbi.nlm.nih.gov) using blastn2 (Altschul et al., *Nucl. Acids. Res.*, 25:3389-3402 (1997)). The parameters for this search were E=0.05, V=50, B=50, where E, V, and B are defined as above.

12. The BAC sequence was compared to the STS division of Genbank database (National Center for Biotechnology Information, National Library of Medicine, 38A, 8N905, 8600 Rockville Pike, Bethesda, Md. 20894; www.ncbi.nlm.nih.gov) using blastn2 (Altschul et al., 1997). The parameters for this search were E=0.05, V=50, B=50, where E, V, and B are defined as above.

13. The BAC sequence was compared to the Expressed Sequence (EST) Tag Genbank database (National Center for Biotechnology Information, National Library of Medicine, 38A, 8N905, 8600 Rockville Pike, Bethesda, Md. 20894; www.ncbi.nlm.nih.gov) using blastn2 (Altschul et al., *Nucl. Acids. Res.*, 25:3389-3402 (1997)). The parameters for this search were E=0.05, V=250, B=250, where E, V, and B are defined as above.

X. Gene Identification by Direct cDNA Selection

Primary linkered cDNA pools were prepared from bone marrow, calvarial bone, femoral bone, kidney, skeletal muscle, testis and total brain. Poly (A)+RNA was prepared from calvarial and femoral bone tissue (Chomczynski et al., *Anal. Biochem.*, 162:156-159 (1987); D'Alessio et al., *Focus*, 9:1-4 (1987)) and the remainder of the mRNA was purchased from Clontech (Palo Alto, Calif.). In order to generate oligo (dT) and random primed cDNA pools from the same tissue, 2.5 μg mRNA was mixed with oligo(dT) primer in one reaction and 2.5 μg mRNA was mixed with random hexamers in another reaction, and both were converted to first and second strand cDNA according to manufacturers recommendations (Life Technologies, Bethesda, Md.). Paired phosphorylated cDNA linkers (see sequence below) were annealed together by mixing in a 1:1 ratio (10 μg each) incubated at 65° C. for five minutes and allowed to cool to room temperature.

```
Paired linkers oligo 1/2

OLIGO 1:
5'CTG AGC GGA ATT CGT GAG ACC3'    (SEQ ID NO:12)

OLIGO 2:
5'TTG GTC TCA CGT ATT CCG CTC GA3' (SEQ ID NO:13)

Paired linkers oligo 3/4

OLIGO 3:
5'CTC GAG AAT TCT GGA TCC TC3'     (SEQ ID NO:14)

OLIGO 4:
5'TTG AGG ATC CAG AAT TCT CGA G3'  (SEQ ID NO:15)

Paired linkers oligo 5/6

OLIGO 5:
5'TGT ATG CGA ATT CGC TGC GCG3'    (SEQ ID NO:16)

OLIGO 6:
5'TTC GCG CAG CGA ATT CGC ATA CA3' (SEQ ID NO:17)

Paired linkers oligo 7/8

OLIGO 7:
5'GTC CAC TGA ATT CTC AGT GAG3'    (SEQ ID NO:18)

OLIGO 8:
5'TTG TCA CTG AGA ATT CAG TGG AC3' (SEQ ID NO:19)

Paired linkers oligo 11/12

OLIGO 11:
5'GAA TCC GAA TTC CTG GTC AGC3'    (SEQ ID NO:20)

OLIGO 12:
5'TTG CTG ACC AGG AAT TCG GAT TC3' (SEQ ID NO:21)
```

Linkers were ligated to all oligo(dT) and random primed cDNA pools (see below) according to manufacturers instructions (Life Technologies, Bethesda, Md.).

Oligo ½ was ligated to oligo(dT) and random primed cDNA pools prepared from bone marrow. Oligo ¾ was ligated to oligo(dT) and random primed cDNA pools prepared from calvarial bone. Oligo ⅚ was ligated to oligo(dT) and random primed cDNA pools prepared from brain and skeletal muscle. Oligo ⅞ was ligated to oligo(dT) and random primed cDNA pools prepared from kidney. Oligo 11/12 was ligated to oligo(dT) and random primed cDNA pools prepared from femoral bone.

The cDNA pools were evaluated for length distribution by PCR amplification using 1 μl of a 1:1, 1:10, and 1:100 dilution of the ligation reaction, respectively. PCR reactions were performed in a Perkin Elmer 9600, each 25 μl volume reaction contained 1 μl of DNA, 10 mM Tris-HCl (pH 8.3), 50 mM KCl, 1.5 mM $MgCl_2$, 0.001% gelatin, 200 mM each dNTPs, 10 μM primer and 1 unit Taq DNA polymerase (Perkin Elmer) and was amplified under the following conditions: 30 seconds at 94° C., 30 seconds at 60° C. and 2 minutes at 72° C. for 30 cycles. The length distribution of the amplified cDNA pools were evaluated by electrophoresis on a 1% agarose gel. The PCR reaction that gave the best representation of the random primed and oligo(dT) primed cDNA pools was scaled up so that ~2-3 μg of each cDNA pool was produced. The starting cDNA for the direct selection reaction comprised of 0.5 μg of random primed cDNAs mixed with 0.5 μg of oligo(dT) primed cDNAs.

The DNA from the 54 BACs that were used in the direct cDNA selection procedure was isolated using Nucleobond AX columns as described by the manufacturer (The Nest Group, Inc.).

The BACs were pooled in equimolar amounts and 1 μg of the isolated genomic DNA was labeled with biotin 16-UTP by nick translation in accordance with the manufacturers instructions (Boehringer Mannheim). The incorporation of the biotin was monitored by methods that could be practiced by one skilled in the art (Del Mastro and Lovett, *Methods in Molecular Biology*, Humana Press Inc., N.J. (1996)).

Direct cDNA selection was performed using methods that could be practiced by one skilled in the art (Del Mastro and Lovett, *Methods in Molecular Biology*, Humana Press Inc., N.J. (1996)). Briefly, the cDNA pools were multiplexed in two separate reactions: In one reaction cDNA pools from bone marrow, calvarial bone, brain and testis were mixed, and in the other cDNA pools from skeletal muscle, kidney and femoral bone were mixed. Suppression of the repeats, yeast sequences and plasmid in the cDNA pools was performed to a Cot of 20. 100 ng of biotinylated BAC DNA was mixed with the suppressed cDNAs and hybridized in solution to a Cot of 200. The biotinylated DNA and the cognate cDNAs was captured on streptavidin-coated paramagnetic beads. The beads were washed and the primary selected cDNAs were eluted. These cDNAs were PCR amplified and a second round of direct selection was performed. The product of the second round of direct selection is referred to as the secondary selected material. A Galanin cDNA clone, previously shown to map to 11q12-13 (Evans, *Genomics*, 18:473-477 (1993)), was used to monitor enrichment during the two rounds of selection.

The secondary selected material from bone marrow, calvarial bone, femoral bone, kidney, skeletal muscle, testis and total brain was PCR amplified using modified primers of oligos 1, 3, 5, 7 and 11, shown below, and cloned into the UDG vector pAMP10 (Life Technologies, Bethesda, Md.), in accordance with the manufacturer's recommendations.

Modified primer sequences:

```
Oligo1-CUA:
5'CUA CUA CUA CUA CTG AGC GGA ATT    (SEQ ID NO:22)
CGT GAG ACC3'

Oligo3-CUA:
5'CUA CUA CUA CUA CTC GAG AAT TCT    (SEQ ID NO:23)
GGA TCC TC3'

Oligo5-CUA:
5'CUA CUA CUA CUA TGT ATG CGA ATT    (SEQ ID NO:24)
CGC TGC GCG3'

Oligo7-CUA:
5'CUA CUA CUA CUA GTC CAC TGA ATT    (SEQ ID NO:25)
```

-continued

```
CTC AGT GAG3'

Oligo11-CUA:
5'CUA CUA CUA CUA GAA TCC GAA TTC    (SEQ ID NO:26)
CTG GTC AGC3'
```

The cloned secondary selected material, from each tissue source, was transformed into MAX Efficiency DH5a Competent Cells (Life Technologies, Bethesda, Md.) as recommended by the manufacturer. 384 colonies were picked from each transformed source and arrayed into four 96 well microtiter plates.

All secondarily selected cDNA clones were sequenced using M13 dye primer terminator cycle sequencing kit (Applied Biosystems), and the data collected by the ABI 377 automated fluorescence sequencer (Applied Biosystems).

All sequences were analyzed using the BLASTN, BLASTX and FASTA programs (Altschul et al., *J. Mol. Biol.*, 215:403-410 (1990), Altschul et al., *Nucl. Acids. Res.*, 25:3389-3402 (1997)). The cDNA sequences were compared to a database containing sequences derived from human repeats, mitochondrial DNA, ribosomal RNA, *E. coli* DNA to remove background clones from the dataset using the program cross_match. A further round of comparison was also performed using the program BLASTN2 against known genes (Genbank) and the BAC sequences from the HBM region. Those cDNAs that were >90% homologous to these sequences were filed according to the result and the data stored in a database for further analysis. cDNA sequences that were identified but did not have significant similarity to the BAC sequences from the HBM region or were eliminated by cross_match were hybridized to nylon membranes which contained the BACs from the HBM region, to ascertain whether they hybridized to the target.

Hybridization analysis was used to map the cDNA clones to the BAC target that selected them. The BACs that were identified from the HBM region were arrayed and grown into a 96 well microtiter plate. LB agar containing 25 μg/ml kanamycin was poured into 96 well microtiter plate lids. Once the agar had solidified, pre-cut Hybond N+ nylon membranes (Amersham) were laid on top of the agar and the BACs were stamped onto the membranes in duplicate using a hand held 96 well replica plater (V&P Scientific, Inc.). The plates were incubated overnight at 37° C. The membranes were processed according to the manufacturers recommendations.

The cDNAs that needed to be mapped by hybridization were PCR amplified using the relevant primer (oligos 1, 3, 5, 7 and 11) that would amplify that clone. For this PCR amplification, the primers were modified to contain a linkered digoxigenin molecule at the 5' of the oligonucleotide. The PCR amplification was performed under the same conditions as described in Preparation of cDNA Pools (above). The PCR products were evaluated for quality and quantity by electrophoresis on a 1% agarose gel by loading 5 μl of the PCR reaction. The nylon membranes containing the stamped BACs were individually pre-hybridized in 50 ml conical tubes containing 10 ml of hybridization solution (5×SSPE, 0.5×Blotto, 2.5% SDS and 1 mM EDTA (pH 8.0)). The 50 ml conical tubes were placed in a rotisserie oven (Robbins Scientific) for 2 hours at 65° C. Twenty-five ng of each cDNA probe was denatured and added into individual 50 ml conical tubes containing the nylon membrane and hybridization solution. The hybridization was performed overnight at 65° C. The filters were washed for 20 minutes at 65° C. in each of the following solutions: 3×SSPE, 0.1% SDS; 1×SSPE, 0.1% SDS and 0.1×SSPE, 0.1% SDS.

The membranes were removed from the 50 ml conical tubes and placed in a dish. Acetate sheets were placed between each membrane to prevent them from sticking to each other. The incubation of the membranes with the Anti-DIG-AP and CDP-Star was performed according to manufacturers recommendations (Boehringer Mannheim). The membranes were wrapped in Saran wrap and exposed to Kodak Bio-Max X-ray film for 1 hour.

XI. cDNA Cloning and Expression Analysis

To characterize the expression of the genes identified by direct cDNA selection and genomic DNA sequencing in comparison to the publicly available databases, a series of experiments were performed to further characterize the genes in the HBM region. First, oligonucleotide primers were designed for use in the polymerase chain reaction (PCR) so that portions of a cDNA, EST, or genomic DNA could be amplified from a pool of DNA molecules (a cDNA library) or RNA population (RT-PCR and RACE). The PCR primers were used in a reaction containing genomic DNA to verify that they generated a product of the size predicted based on the genomic (BAC) sequence. A number of cDNA libraries were then examined for the presence of the specific cDNA or EST. The presence of a fragment of a transcription unit in a particular cDNA library indicates a high probability that additional portions of the same transcription unit will be present as well.

A critical piece of data that is required when characterizing novel genes is the length, in nucleotides, of the processed transcript or messenger RNA (mRNA). One skilled in the art primarily determines the length of an mRNA by Northern blot hybridization (Sambrook et al., *Molecular Cloning: A Laboratory Manual*, Cold Spring Harbor Laboratory, Cold Spring Harbor N.Y. (1989)). Groups of ESTs and direct-selected cDNA clones that displayed significant sequence similarity to sequenced BACs in the critical region were grouped for convenience into approximately 30 kilobase units. Within each 30 kilobase unit there were from one up to fifty ESTs and direct-selected cDNA clones which comprised one or more independent transcription units. One or more ESTs or direct-selected cDNAs were used as hybridization probes to determine the length of the mRNA in a variety of tissues, using commercially available reagents (Multiple Tissue Northern blot; Clontech, Palo Alto, Calif.) under conditions recommended by the manufacturer.

Directionally cloned cDNA libraries from femoral bone, and calvarial bone tissue were constructed by methods familiar to one skilled in the art (for example, Soares in *Automated DNA Sequencing and Analysis*, Adams, Fields and Venter, Eds., Academic Press, NY, pages 110-114 (1994)). Bones were initially broken into fragments with a hammer, and the small pieces were frozen in liquid nitrogen and reduced to a powder in a tissue pulverizer (Spectrum Laboratory Products). RNA was extracted from the powdered bone by homogenizing the powdered bone with a standard Acid Guanidinium Thiocyanate-Phenol-Chloroform extraction buffer (e.g., Chomczynski and Sacchi, *Anal. Biochem.*, 162:156-159 (1987)) using a polytron homogenizer (Brinkman Instruments). Additionally, human brain and lung total RNA was purchased from Clontech. PolyA RNA was isolated from total RNA using dynabeads-dT according to the manufacturer's recommendations (Dynal, Inc.). First strand cDNA synthesis was initiated using an oligonucleotide primer with the sequence:

5'-AACTGGAAGAATTC GCGGCCGCAGGAATTTTTTTTTTTTTTTTT-3' (SEQ ID NO:27). This primer introduces a NotI restriction site (underlined) at the 3' end of the cDNA. First and second strand synthesis were performed using the "one-tube" cDNA synthesis kit as described by the manufacturer (Life Technologies, Bethesda, Md.). Double stranded cDNAs were treated with T4 polynucleotide kinase to ensure that the ends of the molecules were blunt (Soares in *Automated DNA Sequencing and Analysis*, Adams, Fields and Venter, Eds., Academic Press, NY, pages 110-114 (1994)), and the blunt ended cDNAs were then size selected by a Biogel column (Huynh et al in *DNA Cloning*, Vol. 1, Glover, Ed., IRL Press, Oxford, pages 49-78 (1985)) or with a size-sep 400 sepharose column (Pharmacia, catalog #27-5105-01). Only cDNAs of 400 base pairs or longer were used in subsequent steps. EcoRI adapters (sequence: 5' OH-AAT-TCGGCACGAG-OH 3' (SEQ ID NO:28), and 5' p-CTCGTGCCG-OH 3' (SEQ ID NO:29)) were then ligated to the double stranded cDNAs by methods familiar to one skilled in the art (Soares, 1994). The EcoRI adapters were then removed from the 3' end of the cDNA by digestion with NotI (Soares, 1994). The cDNA was then ligated into the plasmid vector pBluescript® II KS+ (Stratagene, La Jolla, Calif.), and the ligated material was transformed into *E. coli* host DH10B or DH12S by electroporation methods familiar to one skilled in the art (Soares, 1994). After growth overnight at 37° C., DNA was recovered from the *E. coli* colonies after scraping the plates by processing as directed for the Mega-prep kit (Qiagen, Chatsworth, Calif.). The quality of the cDNA libraries was estimated by counting a portion of the total numbers of primary transformants and determining the average insert size and the percentage of plasmids with no cDNA insert. Additional cDNA libraries (human total brain, heart, kidney, leukocyte, and fetal brain) were purchased from Life Technologies, Bethesda, Md.

cDNA libraries, both oligo (dT) and random hexamer ($N_6$) primed, were used for isolating cDNA clones transcribed within the HBM region: human bone, human brain, human kidney and human skeletal muscle (all cDNA libraries were made by the inventors, except for skeletal muscle (dT) and kidney (dT) cDNA libraries). Four 10×10 arrays of each of the cDNA libraries were prepared as follows: the cDNA libraries were titered to $2.5 \times 10^6$ using primary transformants. The appropriate volume of frozen stock was used to inoculate 2 L of LB/ampicillin (100 mg/ml). This inoculated liquid culture was aliquotted into 400 tubes of 4 ml each. Each tube contained approximately 5000 cfu. The tubes were incubated at 30° C. overnight with gentle agitation. The cultures were grown to an OD of 0.7-0.9. Frozen stocks were prepared for each of the cultures by aliquotting 100 µl of culture and 300 µl of 80% glycerol. Stocks were frozen in a dry ice/ethanol bath and stored at −70° C. The remaining culture was DNA prepared using the Qiagen (Chatsworth, Calif.) spin miniprep kit according to the manufacturer's instructions. The DNAs from the 400 cultures were pooled to make 80 column and row pools. The cDNA libraries were determined to contain HBM cDNA clones of interest by PCR. Markers were designed to amplify putative exons. Once a standard PCR optimization was performed and specific cDNA libraries were determined to contain cDNA clones of interest, the markers were used to screen the arrayed library. Positive addresses indicating the presence of cDNA clones were confirmed by a second PCR using the same markers.

Once a cDNA library was identified as likely to contain cDNA clones corresponding to a specific transcript of interest from the HBM region, it was manipulated to isolate the clone or clones containing cDNA inserts identical to the EST or direct-selected cDNA of interest. This was accomplished by a modification of the standard "colony screening" method (Sambrook et al., *Molecular Cloning: A Laboratory Manual*, Cold Spring Harbor Laboratory, Cold Spring Harbor N.Y. (1989)). Specifically, twenty 150 mm LB+ampicillin agar plates were spread with 20,000 colony forming units (cfu) of cDNA library and the colonies allowed to grow overnight at 37° C. Colonies were transferred to nylon filters (Hybond from Amersham, or equivalent) and duplicates prepared by pressing two filters together essentially as described (Sambrook et al., *Molecular Cloning: A Laboratory Manual*, Cold Spring Harbor Laboratory, Cold Spring Harbor N.Y. (1989)). The "master" plate was then incubated an additional 6-8 hours to allow the colonies to grow back. The DNA from the bacterial colonies was then affixed to the nylon filters by treating the filters sequentially with denaturing solution (0.5 N NaOH, 1.5 M NaCl) for two minutes, neutralization solution (0.5 M Tris-Cl pH 8.0, 1.5 M NaCl) for two minutes (twice). The bacterial colonies were removed from the filters by washing in a solution of 2×SSC/0.1% SDS for one minute while rubbing with tissue paper. The filters were air dried and baked under vacuum at 80° C. for 1-2 hours.

A cDNA hybridization probe was prepared by random hexamer labeling (Fineberg and Vogelstein, *Anal. Biochem.*, 132:6-13 (1983)) or by including gene-specific primers and no random hexamers in the reaction (for small fragments). Specific activity was calculated and was >5×10$^8$ cpm/10$^8$ µg of cDNA. The colony membranes were then prewashed in 10 mM Tris-Cl pH 8.0, 1 M NaCl, 1 mM EDTA, 0.1% SDS for 30 minutes at 55° C. Following the prewash, the filters were prehybridized in >2 ml/filter of 6×SSC, 50% deionized formamide, 2% SDS, 5× Denhardt's solution, and 100 mg/ml denatured salmon sperm DNA, at 42° C. for 30 minutes. The filters were then transferred to hybridization solution (6×SSC, 2% SDS, 5× Denhardt's, 100 mg/ml denatured salmon sperm DNA) containing denatured $\alpha^{32}$P-dCTP-labeled cDNA probe and incubated at 42° C. for 16-18 hours.

After the 16-18 hour incubation, the filters were washed under constant agitation in 2×SSC, 2% SDS at room temperature for 20 minutes, followed by two washes at 65° C. for 15 minutes each. A second wash was performed in 0.5×SSC, 0.5% SDS for 15 minutes at 65° C. Filters were then wrapped in plastic wrap and exposed to radiographic film for several hours to overnight. After film development, individual colonies on plates were aligned with the autoradiograph so that they could be picked into a 1 ml solution of LB Broth containing ampicillin. After shaking at 37° C. for 1-2 hours, aliquots of the solution were plated on 150 mm plates for secondary screening. Secondary screening was identical to primary screening (above) except that it was performed on plates containing ~250 colonies so that individual colonies could be clearly identified for picking.

After colony screening with radiolabeled probes yielded cDNA clones, the clones were characterized by restriction endonuclease cleavage, PCR, and direct sequencing to confirm the sequence identity between the original probe and the isolated clone. To obtain the full-length cDNA, the novel sequence from the end of the clone identified was used to probe the library again. This process was repeated until the length of the cDNA cloned matches that estimated to be full-length by the northern blot analysis.

RT-PCR was used as another method to isolate full length clones. The cDNA was synthesized and amplified using a "Superscript One Step RT-PCR" kit (Life Technologies, Gaithersburg, Md.). The procedure involved adding 1.5 µg of RNA to the following: 25 µl of reaction mix provided which is a proprietary buffer mix with MgSO$_4$ and dNTP's, 1 µl sense primer (10 µM) and 1 µl anti-sense primer (10 µM), 1 µl reverse transcriptase and Taq DNA polymerase mix provided and autoclaved water to a total reaction mix of 50 µl. The reaction was then placed in a thermocycler for 1 cycle at 50° C. for 15 to 30 minutes, then 94° C. for 15 seconds, 55-60° C. for 30 seconds and 68-72° C. for 1 minute per kilobase of anticipated product and finally 1 cycle of 72° C. for 5-10 minutes. The sample was analyzed on an agarose gel. The product was excised from the gel and purified from the gel (GeneClean, Bio 101). The purified product was cloned in pCTNR (General Contractor DNA Cloning System, 5 Prime-3 Prime, Inc.) and sequenced to verify that the clone was specific to the gene of interest.

Rapid Amplification of cDNA ends (RACE) was performed following the manufacturer's instructions using a Marathon cDNA Amplification Kit (Clontech, Palo Alto, Calif.) as a method for cloning the 5' and 3' ends of candidate genes. cDNA pools were prepared from total RNA by performing first strand synthesis, where a sample of total RNA sample was mixed with a modified oligo (dT) primer, heated to 70° C., cooled on ice and followed by the addition of: 5× first strand buffer, 10 mM dNTP mix, and AMV Reverse Transcriptase (20 U/µl). The tube was incubated at 42° C. for one hour and then the reaction tube was placed on ice. For second strand synthesis, the following components were added directly to the reaction tube: 5× second strand buffer, 10 mM dNTP mix, sterile water, 20× second strand enzyme cocktail and the reaction tube was incubated at 16° C. for 1.5 hours. T4 DNA Polymerase was added to the reaction tube and incubated at 16° C. for 45 minutes. The second-strand synthesis was terminated with the addition of an EDTA/Glycogen mix. The sample was subjected to a phenol/chloroform extraction and an ammonium acetate precipitation. The cDNA pools were checked for quality by analyzing on an agarose gel for size distribution. Marathon cDNA adapters (Clontech) were then ligated onto the cDNA ends. The specific adapters contained priming sites that allowed for amplification of either 5' or 3' ends, depending on the orientation of the gene specific primer (GSP) that was chosen. An aliquot of the double stranded cDNA was added to the following reagents: 10 µM Marathon cDNA adapter, 5× DNA ligation buffer, T4 DNA ligase. The reaction was incubated at 16° C. overnight. The reaction was heat inactivated to terminate the reaction. PCR was performed by the addition of the following to the diluted double stranded cDNA pool: 10× cDNA PCR reaction buffer, 10 µM dNTP mix, 10 µM GSP, 10 µM AP1 primer (kit), 50× Advantage cDNA Polymerase Mix. Thermal Cycling conditions were 94° C. for 30 seconds, 5 cycles of 94° C. for 5 seconds, 72° C. for 4 minutes, 5 cycles of 94° C. for 5 seconds, 70° C. for 4 minutes, 23 cycles of 94° C. for 5 seconds, 68° C. for 4 minutes. After the first round of PCR was performed using the GSP to extend to the end of the adapter to create the adapter primer binding site, exponential amplification of the specific cDNA of interest was observed. Usually a second nested PCR is performed to confirm the specific cDNA. The RACE product was analyzed on an agarose gel and then excised and purified from the gel (GeneClean, BIO 101). The RACE product was then cloned into pCTNR (General Contractor DNA Cloning System, 5'-3', Inc.) and the DNA sequence determined to verify that the clone is specific to the gene of interest.

XII. Mutation Analysis

Comparative genes were identified using the above procedures and the exons from each gene were subjected to mutation detection analysis. Comparative DNA sequencing was used to identify polymorphisms in HBM candidate genes from chromosome 11q12-13. DNA sequences for candidate genes were amplified from patient lymphoblastoid cell lines.

The inventors developed a method based on analysis of direct DNA sequencing of PCR products amplified from candidate regions to search for the causative polymorphism. The procedure consisted of three stages that used different subsets of HBM family to find segregating polymorphisms and a population panel to assess the frequency of the polymorphisms. The family resources result from a single founder leading to the assumption that all affected individuals will share the same causative polymorphism.

Candidate regions were first screened in a subset of the HBM family consisting of the proband, daughter, and her mother, father and brother. Monochromosomal reference sequences were produced concurrently and used for comparison. The mother and daughter carried the HBM polymorphism in this nuclear family, providing the ability to monitor polymorphism transmission. The net result is that two HBM chromosomes and six non-HBM chromosomes were screened. This allowed exclusion of numerous frequent alleles. Only alleles exclusively present in the affected individuals passed to the next level of analysis.

Polymorphisms that segregated exclusively with the HBM phenotype in this original family were then re-examined in an extended portion of the HBM pedigree consisting of two additional nuclear families. These families consisted of five HBM and three unaffected individuals. The HBM individuals in this group included the two critical crossover individuals, providing the centromeric and telomeric boundaries of the critical region. Tracking the heredity of polymorphisms between these individuals and their affected parents allowed for further refining of the critical region. This group brought the total of HBM chromosomes screened to seven and the total of non-HBM chromosomes to seventeen.

When a given polymorphism continued to segregate exclusively with the HBM phenotype in the extended group, a population panel was then examined. This panel of 84 persons consisted of 42 individuals known to have normal bone mineral density and 42 individuals known to be unrelated but with untyped bone mineral density. For this purpose, normal bone mineral density is within two standard deviations of a BMD Z score of 0. The second group was from the widely used CEPH panel of individuals. Any segregating polymorphisms found to be rare in this population were subsequently examined on the entire HBM pedigree and a larger population.

Polymerase chain reaction (PCR) was used to generate sequencing templates from the HBM family's DNA and monochromosomal controls. Enzymatic amplification of genes within the HBM region on 11q12-13 was accomplished using the PCR with oligonucleotides flanking each exon as well as the putative 5' regulatory elements of each gene. The primers were chosen to amplify each exon as well as 15 or more base pairs within each intron on either side of the splice. All PCR primers were made as chimeras to facilitate dye primer sequencing. The M13-21F (5'-GTA A CGA CGG CCA GT-3') (SEQ ID NO:30) and −28REV (5'-AAC AGC TAT GAC CAT G-3') (SEQ ID NO:31) primer binding sites were built on to the 5' end of each forward and reverse PCR primer, respectively, during synthesis. 150 ng of genomic DNA was used in a 50 µl PCR with 2 U AmpliTaq, 500 nM primer and 125 µM dNTP. Buffer and cycling conditions were specific to each primer set. TaqStart antibody (Clontech) was used for hot start PCR to minimize primer dimer formation. 10% of the product was examined on an agarose gel. The appropriate samples were diluted 1:25 with deionized water before sequencing.

Each PCR product was sequenced according to the standard Energy Transfer primer (Amersham) protocol. All reactions took place in 96 well trays. 4 separate reactions, one each for A, C, G and T were performed for each template. Each reaction included 2 µl of the sequencing reaction mix and 3 µl of diluted template. The plates were then heat sealed with foil tape and placed in a thermal cycler and cycled according to the manufacturer's recommendation. After cycling, the 4 reactions were pooled. 3 µl of the pooled product was transferred to a new 96 well plate and 1 µl of the manufacturer's loading dye was added to each well. All 96 well pipetting procedures occurred on a Hydra 96 pipetting station (Robbins Scientific, USA). 1 µl of pooled material was directly loaded onto a 48 lane gel running on an ABI 377 DNA sequencer for a 10 hour, 2.4 kV run.

Polyphred (University of Washington) was used to assemble sequence sets for viewing with Consed (University of Washington). Sequences were assembled in groups representing all relevant family members and controls for a specified target region. This was done separately for each of the three stages. Forward and reverse reads were included for each individual along with reads from the monochromosomal templates and a color annotated reference sequence. Polyphred indicated potential polymorphic sites with a purple flag. Two readers independently viewed each assembly and assessed the validity of the purple-flagged sites.

A total of 23 exons present in the mature mRNA and several other portions of the primary transcript were evaluated for heterozygosity in the nuclear family of two HBM-affected and two unaffected individuals. 25 SNPs were identified, as shown in the table below.

TABLE 4

Single Nucleotide Polymorphisms in the LRP5 gene and Environs

| Exon Name | Location | Base Change |
|---|---|---|
| b200e21-h_Contig1_1.nt | 69169 (309G) | C/A |
| b200e21-h_Contig4_12.nt | 27402 (309G) | A/G |
| b200e21-h_Contig4_13.nt | 27841 (309G) | T/C |
| b200e21-h_Contig4_16.nt | 35600 (309G) | A/G |
| b200e21-h_Contig4_21.nt | 45619 (309G) | G/A |
| b200e21-h_Contig4_22.nt-a | 46018 (309G) | T/G |
| b200e21-h_Contig4_22.nt-b | 46093 (309G) | T/G |
| b200e21-h_Contig4_22.nt-c | 46190 (309G) | A/G |
| b200e21-h_Contig4_24.nt-a | 50993 (309G) | T/C |
| b200e21-h_Contig4_24.nt-b | 51124 (309G) | C/T |
| b200e21-h_Contig4_25.nt | 55461 (309G) | C/T |
| b200e21-h_Contig4_33.nt-a | 63645 (309G) | C/A |
| b200e21-h_Contig4_33.nt-b | 63646 (309G) | A/C |
| b200e21-h_Contig4_61.nt | 24809 (309G) | T/G |
| b200e21-h_Contig4_62.nt | 27837 (309G) | T/C |
| b200e21-h_Contig4_63.nt-a | 31485 (309G) | C/T |
| b200e21-h_Contig4_63.nt-b | 31683 (309G) | A/G |
| b200e21-h_Contig4_9.nt | 24808 (309G) | T/G |
| b527d12-h_Contig030g_1.nt-a | 31340 (308G) | T/C |
| b527d12-h_Contig030g_1.nt-b | 32538 (308G) | A/G |
| b527d12-h_Contig080C_2.nt | 13224 (308G) | A/G |
| b527d12-h_Contig087C_1.nt | 21119 (308G) | C/A |
| b527d12-h_Contig087C_4.nt | 30497 (308G) | G/A |
| b527d12-h_Contig088C_4.nt | 24811 (309G) | A/C |
| b527d12-h_Contig089_1HP.nt | 68280 (309G) | G/A |

In addition to the polymorphisms presented in Table 4, two additional polymorphisms can also be present in SEQ ID NO:2. These are a change at position 2002 of SEQ ID NO:2. Either a guanine or an adenine can appear at this position. This polymorphism is silent and is not associated with any change in the amino acid sequence. The second change is at position 4059 of SEQ ID NO:2 corresponding in a cytosine (C) to thymine (T) change. This polymorphism results in a corresponding amino acid change from a valine (V) to an alanine (A). Other polymorphisms were found in the candidate gene exons and adjacent intron sequences. Any one or combination of the polymorphisms listed in Table 4 or the two discussed above could also have a minor effect on bone mass when present in SEQ ID NO:2.

The present invention encompasses the nucleic acid sequences having the nucleic acid sequence of SEQ ID NO: 1 with the above-identified point mutations.

Figure 5:
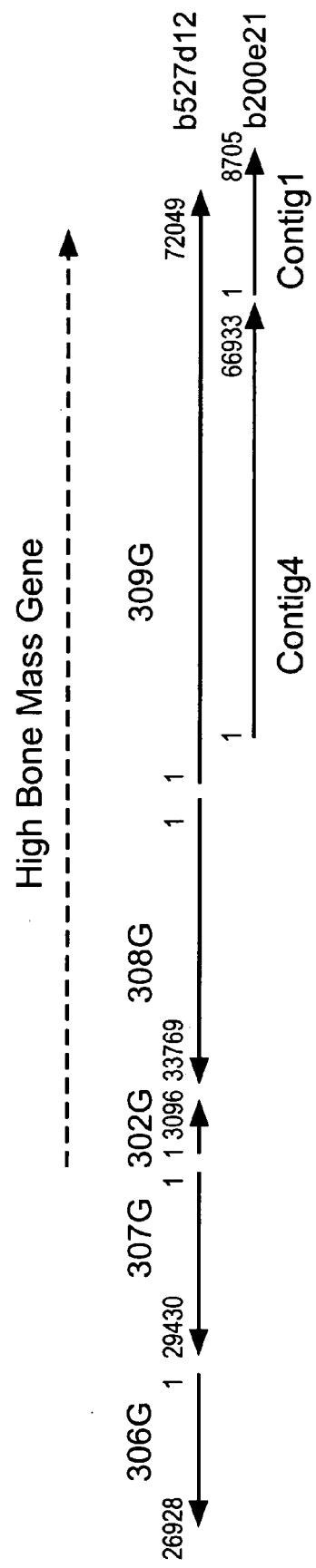
FIG. 5 is a schematic illustration of the BAC contigs B527D12 and B200E21 in relation to the HBM gene.

Preferably, the present invention encompasses the nucleic acid of SEQ ID NO: 2. Specifically, a base-pair substitution changing G to T at position 582 in the coding sequence of LRP5 (the HBM gene) was identified as heterozygous in all HBM individuals, and not found in the unaffected individuals (i.e., b527d12-h_Contig087C__1.nt). FIG. 5 shows the order of the contigs in B527D12. The direction of transcription for the HBM gene is from left to right. The sequence of contig308G of B527D12 is the reverse complement of the coding region to the HBM gene. Therefore, the relative polymorphism in contig 308G shown in Table 4 as a base change substitution of C to A is the complement to the G to T substitution in the HBM gene. This mutation causes a substitution of glycine 171 with valine (G171V).

The HBM polymorphism was confirmed by examining the DNA sequence of different groups of individuals. In all members of the HBM pedigree (38 individuals), the HBM polymorphism was observed in the heterozygous form in affected (i.e., elevated bone mass) individuals only (N=18). In unaffected relatives (N=20) (BMDZ<2.0) the HBM polymorphism was never observed. To determine whether this polymorphism was ever observed in individuals outside of the HBM pedigree, 297 phenotyped individuals were characterized at the site of the HBM gene. None were heterozygous at the site of the HBM polymorphism. In an unphenotyped control group, none of 64 individuals were observed to be heterozygous at position 582. Taken together, these data prove that the polymorphism observed in the kindred displaying the high bone mass phenotype is strongly correlated with the G—T polymorphism at position 582 of LRP5. Furthermore, these results coupled with the ASO results described below, establish that the HBM polymorphism genetically segregates with the HBM phenotype, and that both the HBM polymorphism and phenotype are rare in the general population.

XIII. Allele Specific Oligonucleotide (ASO) Analysis

The amplicon containing the HBM polymorphism was PCR amplified using primers specific for the exon of interest. The appropriate population of individuals was PCR amplified in 96 well microtiter plates as follows. PCR reactions (20 µl) containing 1× Promega PCR buffer (Cat. #M1883 containing 1.5 mM $MgCl_2$), 100 mM dNTP, 200 nM PCR primers (SEQ ID NOS: 629-630) (1863F: CCAAGTTCTGAGAAGTCC and 1864R: AATACCTGAAACCATACCTG), 1 U Amplitaq, and 20 ng of genomic DNA were prepared and amplified under the following PCR conditions: 94° C., 1 minute, (94° C., 30 sec.; 58° C., 30 sec.; 72° C., 1 min.×35 cycles), 72° C., 5' min, 4° C., hold. Loading dye was then added and 10 µl of the products was electrophoresed on 1.5% agarose gels containing 1 µg/ml ethidium bromide at 100-150 V for 5-10 minutes. Gels were treated 20 minutes in denaturing solution (1.5 M NaCl, 0.5 N NaOH), and rinsed briefly with water. Gels were then neutralized in 1 M Tris-HCl, pH 7.5, 1.5 M NaCl, for 20 minutes and rinsed with water. Gels were soaked in 10×SSC for 20 minutes and blotted onto nylon transfer membrane (Hybond N+–Amersham) in 10×SSC overnight. Filters were the rinsed in 6×SSC for 10 minutes and UV crosslinked.

The allele specific oligonucleotides (ASO) were designed with the polymorphism approximately in the middle. Oligonucleotides were phosphate free at the 5' end and were purchased from Gibco BRL. Sequences of the oligonucleotides are (SEQ ID NOS: 631-632):

```
2326 ZMAX.ASO.g:     AGACTGGGGTGAGACGC

2327 ZMAX.ASO.t:     CAGACTGGGTTGAGACGCC
```

The polymorphic nucleotides are underlined. To label the oligos, 1.5 µl of 1 µg/µl ASO oligo (2326.ZMAX.ASO.g or 2327.ZMAX.ASO.t), 11 µl $ddH_2O$, 2 µl 10× kinase forward buffer, 5 µl $\gamma^{32}P$-ATP (6000 Ci/mMole), and 1 µl T4 polynucleotide kinase (10 U/µl) were mixed, and the reaction incubated at 37° C. for 30-60 minutes. Reactions were then placed at 95° C. for 2 minutes and 30 ml $H_2O$ was added. The probes were purified using a G25 microspin column (Pharmacia).

Blots were prehybridized in 10 ml 5×SSPE, 5× Denhardt's, 2% SDS, and 100 µg/ml, denatured, sonicated salmon sperm DNA at 40° C. for 2 hr. The entire reaction mix of kinased oligo was then added to 10 ml fresh hybridization buffer (5×SSPE, 5× Denhardt's, 2% SDS) and hybridized at 40° C. for at least 4 hours to overnight.

All washes done in 5×SSPE, 0.1% SDS. The first wash was at 45° C. for 15 minutes; the solution was then changed and the filters washed 50° C. for 15 minutes. Filters were then exposed to Kodak biomax film with 2 intensifying screens at −70° C. for 15 minutes to 1 hr. If necessary the filters were washed at 55° C. for 15 minutes and exposed to film again. Filters were stripped by washing in boiling 0.1×SSC, 0.1% SDS for 10 minutes at least 3 times.

The two films that best captured the allele specific assay with the 2 ASOs were converted into digital images by scanning them into Adobe PhotoShop. These images were overlaid against each other in Graphic Converter and then scored and stored in FileMaker Pro 4.0 (see FIG. 9).

In order to determine the HBM allele frequency in ethnically diverse populations, 672 random individuals from various ethnic groups were typed by the allele specific oligonucleotide (ASO) method. This population included 96 CEPH grandparents (primarily Caucasian), 192 Caucasian, 192 African-American, 96 Hispanic, and 96 Asian individuals. No evidence was obtained for the presence of the HBM polymorphism in any of these individuals. Overall, a total of 911 individuals were typed either by direct sequencing or ASO hybridization; all were homozygous GG at the site of the HBM polymorphism (FIG. 14). This information illustrates that the HBM allele is rare in various ethnic populations.

Thus this invention provides a rapid method of identifying individuals with the HBM allele. This method could be used in the area of diagnostics and screening of an individual for susceptibility to osteoporosis or other bone disorder. The assay could also be used to identify additional individuals with the HBM allele or the additional polymorphisms described herein.

XIV. Cellular Localization of LRP5

Gene Expression in Rat Tibia by Non Isotopic In Situ Hybridization

In situ hybridization was conducted by Pathology Associates International (PAI), Frederick, Md. This study was undertaken to determine the specific cell types that express the LRP5 gene in rat bone with particular emphasis on areas of bone growth and remodeling. LRP5 probes used in this study were generated from both human (HuZmax1) and mouse (MsZmax1) cDNAs, which share an 87% sequence identity. The homology of human and mouse LRP5 with rat LRP5 is unknown.

For example, gene expression by non-isotopic in situ hybridization was performed as follows, but other methods would be known to the skilled artisan. Tibias were collected from two 6 to 8 week old female Sprague Dawley rats euthanized by carbon dioxide asphyxiation. Distal ends were removed and proximal tibias were snap frozen in OCT embedding medium with liquid nitrogen immediately following death. Tissues were stored in a −80° C. freezer.

Probes for amplifying PCR products from cDNA were prepared as follows. The primers to amplify PCR products from a cDNA clone were chosen using published sequences of both human LRP5 (Genbank Accession No. ABO17498) and mouse LRP5 (Genbank Accession No. AF064984). In order to minimize cross reactivity with other genes in the LDL receptor family, the PCR products were derived from an intracellular portion of the protein coding region. PCR was performed in a 50 µl reaction volume using cDNA clone as template. PCR reactions contained 1.5 mM MgCl$_2$, 1 unit Amplitaq, 200 µM dNTPs and 2 µM each primer. PCR cycling conditions were 94° C. for 1 min., followed by 35 cycles of 94° C. for 30 seconds, 55° C. for 30 seconds, 72° C. for 30 seconds; followed by a 5 minute extension at 72° C. The reactions were then run on a 1.5% agarose Tris-Acetate gel. DNA was eluted from the agarose, ethanol precipitated and resuspended in 10 mM Tris, pH 8.0. Gel purified PCR products were prepared for both mouse and human cDNAs and supplied to Pathology Associates International for in situ hybridizations.

The sequence of the human and mouse PCR primers and products were as follows:

```
Human LRP5 sense primer (SEQ ID NO:633) (HBM253)
CCCGTGTGCTCCGCCGCCCAGTTC

Human LRP5 antisense primer (SEQ ID NO:634)
(HBM465)
GGCTCACGGAGCTCATCATGGACTT

Human LRP5 PCR product (SEQ ID NO:635)
CCCGTGTGCTCCGCCGCCCAGTTCCCCTGCGCGCGGGGTCAGTGTGTGGA

CCTGCGCCTGCGCTGCGACGGCGAGGCAGACTGTCAGGACCGCTCAGACG

AGGTGGACTGTGACGCCATCTGCCTGCCCAACCAGTTCCGGTGTGCGAGC

GGCCAGTGTGTCCTCATCAAACAGCAGTGCGACTCCTTCCCCGACTGTAT

CGACGGCTCCGACGAGCTCATGTGTGAAATCACCAAGCCGCCCTCAGACG

ACAGCCCGGCCCACAGCAGTGCCATCGGGCCCGTCATTGGCATCATCCTC
```

```
TCTCTCTTCGTCATGGGTGGTGTCTATTTTGTGTGCCAGCGCGTGGTGTG

CCAGCGCTATGCGGGGGCCAACGGGCCCTTCCCGCACGAGTATGTCAGCG

GGACCCCGCACGTGCCCCTCAATTTCATAGCCCCGGGCGGTTCCCAGCAT

GGCCCCTTCACAGGCATCGCATGCGGAAAGTCCATGATGAGCTCCGTGAG

CC

Mouse LRP5 Sense primer (SEQ ID NO:636) (HBM655)
AGCGAGGCCACCATCCACAGG

Mouse LRP5 antisense primer (SEQ ID NO:637)
(HBM656)
TCGCTGGTCGGCATAATCAAT

Mouse LRP5 PCR product (SEQ ID NO:638)
AGCAGAGCCACCATCCACAGGATCTCCCTGGAGACTAACAACAACGATGT

GGCTATCCCACTCACGGGTGTCAAAGAGGCCTCTGCACTGGACTTTGATG

TGTCCAACAATCACATCTACTGGACTGATGTTAGCCTCAAGACGATCAGC

CGAGCCTTCATGAATGGGAGCTCAGTGGAGCACGTGATTGAGTTTGGCCT

CGACTACCCTGAAGGAATGGCTGTGGACTGGATGGGCAAGAACCTCTATT

GGGCGGACACAGGGACCAACAGGATTGAGGTGGCCCGGCTGGATGGGCAG

TTCCGGCAGGTGCTTGTGTGGAGAGACCTTGACAACCCCAGGTCTCTGGC

TCTGGATCCTACTAAAGGCTACATCTACTGGACTGAGTGGGGTGGCAAGC

CAAGGATTGTGCGGGCCTTCATGGATGGGACCAATTGTATGACACTGGTA

GACAAGGTGGGCCGGGCCAACGACCTCACCATTGATTATGCCGACCAGCG

A
```

Riboprobes were synthesized as follows. The PCR products were reamplified with chimeric primers designed to incorporate either a T3 promoter upstream, or a T7 promoter downstream of the reamplification products. The resulting PCR products were used as template to synthesize digoxigenin-labeled riboprobes by in vitro transcription (IVT). Antisense and sense riboprobes were synthesized using T7 and T3 RNA polymerases, respectively, in the presence of digoxigenin-11-UTP (Boehringer-Mannheim) using a MAXIscript IVT kit (Ambion) according to the manufacturer. The DNA was then degraded with Dnase-1, and unincorporated digoxigenin was removed by ultrafiltration. Riboprobe integrity was assessed by electrophoresis through a denaturing polyacrylamide gel. Molecular size was compared with the electrophoretic mobility of a 100-1000 base pair (bp) RNA ladder (Ambion). Probe yield and labeling was evaluated by blot immunochemistry. Riboprobes were stored in 5 µl aliquots at −80° C.

The in situ hybridization was performed as follows. Frozen rat bone was cut into 5 µM sections on a Jung CM3000 cryostat (Leica) and mounted on adhesive slides (Instrumedics). Sections were kept in the cryostat at −20° C. until all the slides were prepared in order to prevent mRNA degradation prior to post-fixation for 15 minutes in 4% paraformaldehyde. Following post-fixation, sections were incubated with 1 ng/µl of either antisense or sense riboprobe in Pathology Associates International (PAI) customized hybridization buffer for approximately 40 hours at 58° C. Following hybridization, slides were subjected to a series of post-hybridization stringency washes to reduce nonspecific probe binding. Hybridization was visualized by immunohistochemistry with an anti-digoxigenin antibody (FAB fragment) conjugated to alkaline phosphatase. Nitroblue tetrazolium chloride/bromochloroindolyl phosphate (Boehringer-Mannheim), a precipitating alkaline phosphatase substrate, was used as the chromogen to stain hybridizing cells purple to nearly black, depending on the degree of staining. Tissue sections were counter-stained with nuclear fast red. Assay controls included omission of the probe, omission of probe and anti-digoxigenin antibody.

Specific cell types were assessed for demonstration of hybridization with antisense probes by visualizing a purple to black cytoplasmic and/or peri-nuclear staining indicating a positive hybridization signal for mRNA. Each cell type was compared to the replicate sections, which were hybridized with the respective sense probe. Results were considered positive if staining was observed with the antisense probe and no staining or weak background with the sense probe.

The cellular localization of the hybridization signal for each of the study probes is summarized in Table 5. Hybridization for LRP5 was primarily detected in areas of bone involved in remodeling, including the endosteum and trabecular bone within the metaphysis. Hybridization in selected bone lining cells of the periosteum and epiphysis were also observed. Positive signal was also noted in chondrocytes within the growth plate, particularly in the proliferating chondrocytes. See FIGS. 10, 11 and 12 for representative photomicrographs of in situ hybridization results.

TABLE 5

Summary of LRP5 in situ hybridization in rat tibia

| PROBE | SITE | ISH SIGNAL |
|---|---|---|
| HuZmax1 | Epiphysis | |
| | Osteoblasts | + |
| | Osteoclasts | − |
| | Growth Plate | |
| | resting chondrocytes | − |
| | proliferating chondrocytes | + |
| | hypertrophic chondrocytes | − |
| | Metaphysis | |
| | osteoblasts | + |
| | osteoclasts | + |
| | Diaphysis | − |
| | Endosteum | |
| | osteoblasts | + |
| | osteoclasts | + |
| | Periosteum | − |
| MsZmax1 | Epiphysis | |
| | Osteoblasts | + |
| | Osteoclasts | − |
| | Growth Plate | |
| | resting chondrocytes | − |
| | proliferating chondrocytes | + |
| | hypertrophic chondrocytes | + |
| | Metaphysis | |
| | osteoblasts | + |
| | osteoclasts | + |
| | Diaphysis | − |
| | Endosteum | |
| | osteoblasts | + |
| | osteoclasts | + |
| | Periosteum | + |

Legend:
"+" = hybridization signal detected
"−" = no hybridization signal detected
"ISH"—In situ hybridization These studies confirm the positional expression of LRP5 in cells involved in bone remodeling and bone formation. LRP5 expression in the zone of proliferation and in the osteoblasts and osteoclasts of the proximal metaphysis, suggests that the LRP5 gene is involved in the process of bone growth and mineralization. The activity and differentiation of osteoblasts and osteoclasts are closely coordinated during development as bone is formed and during growth as well as in adult life as bone undergoes continuous remodeling. The formation of internal bone structures and bone remodeling result from the coupling of bone resorption by activated osteoclasts with subsequent deposition of new material by osteoblasts. LRP5 is related to the LDL receptor gene, and thus may be a receptor involved in mechanosensation and subsequent signaling in the process of bone remodeling. Therefore, changes in the level of expression of this gene could impact on the rate of remodeling and degree of mineralization of bone.

XV. Antisense

Antisense oligonucleotides are short synthetic nucleic acids that contain complementary base sequences to a targeted RNA. Hybridization of the RNA in living cells with the antisense oligonucleotide interferes with RNA function and ultimately blocks protein expression. Therefore, any gene for which the partial sequence is known can be targeted by an antisense oligonucleotide.

Antisense technology is becoming a widely used research tool and will play an increasingly important role in the validation and elucidation of therapeutic targets identified by genomic sequencing efforts.

Antisense technology was developed to inhibit gene expression by utilizing an oligonucleotide complementary to the mRNA that encodes the target gene. There are several possible mechanisms for the inhibitory effects of antisense oligonucleotides. Among them, degradation of mRNA by RNase H is considered to be the major mechanism of inhibition of protein function. This technique was originally used to elucidate the function of a target gene, but may also have therapeutic applications, provided it is designed carefully and properly.

An antisense oligonucleotide can be, for example, about 5, 10, 15, 20, 25, 30, 35, 40, 45, 50, or more, or any integer number in between, nucleotides in length. An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethlaminomethyluracil, dihydrouracil, beta-D-galactosylqueosine, inosine, N6-isopentenyladenine, I-methylguanine, I-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), t-methyl-2-thiouracil, 3-(3-amino-3-N-2-carboxypropyl) uracil, (acp3)w, and 2,6-diaminopurine.

In addition, the use of morpholino oligonucleotides could be employed. Morpholinos are oligomers with modification of the ribose moiety to a morpholino group. This technology is covered by U.S. Pat. No. 5,185,444 and is described in Summerton and Weller *Antisense Nucleic Acid Drug Dev.* 1997 June; 7(3): 187-95. The antisense nucleic acid molecules of the invention are typically administered to a subject or generated in situ such that they hybridize with or bind to cellular mRNA and/or genomic DNA encoding an HBM or LRP5 protein or a protein which interacts with LRP5 and/or HBM to thereby inhibit expression of the protein, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. An example of a route of administration of an antisense nucleic acid molecule of the invention includes direct injection at a tissue site. Alternatively, an antisense nucleic acid molecule can be modified to target selected cells and then administered systemically. For example, for systemic administration, an antisense molecule can be modified such that it specifically binds to a receptor or an antigen expressed on a selected cell surface, e.g., by linking the antisense nucleic acid molecule to a peptide or an antibody which binds to a cell surface receptor or antigen. The antisense nucleic acid molecule can also be delivered to cells using the vectors described herein.

In yet another embodiment, the antisense nucleic acid molecule of the invention is an α-anomeric nucleic acid molecule. An µ-anomeric nucleic acid molecule forms specific double-stranded hybrids with complementary RNA in which, contrary to the usual γ-units, the strands run parallel to each other (Gaultier et al. (1987) *Nucleic Acids. Res.* 15:6625-6641). The antisense nucleic acid molecule can also comprise a 2'-o-methylribonucleotide (Inoue et al. (1987) *Nucleic Acids Res.* 15:6131-6148) or a chimeric RNA-DNA analogue (Inoue et al. (1987) *FEBS Lett.* 215:327-330). In still another embodiment, an antisense nucleic acid of the invention is a ribozyme. Ribozymes are catalytic RNA molecules with ribonuclease activity which are capable of cleaving a single-stranded nucleic acid, such as an mRNA, to which they have a complementary region. Thus, ribozymes (e.g., hammerhead ribozymes (described in Haselhoff and Gerlach (1988) *Nature* 334:585-591)) can be used to catalytically cleave LRP5 or HBM mRNA transcripts to thereby inhibit translation of LRP5 or HBM mRNA. A ribozyme having specificity for a LRP5- or HBM-encoding nucleic acid can be designed based upon the nucleotide sequence of a LRP5 or HBM cDNA disclosed herein (i.e., SEQ ID NO:1 or 3). For example, a derivative of a Tetrahymena L-19 IVS RNA can be constructed in which the nucleotide sequence of the active site is complementary to the nucleotide sequence to be cleaved in an HBM or LRP5-encoding mRNA. See, e.g., Cech et al. U.S. Pat. No. 4,987,071 and Cech et al. U.S. Pat. No. 5,116,742 both incorporated herein by reference. Alternatively, LRP5 or HBM mRNA can be used to select a catalytic RNA having a specific ribonuclease activity from a pool of RNA molecules. See, e.g., Bartel, D. and Szostak, J. W. (1993) Science 261:1411-1418. Alternatively LRP5 or HBM gene expression can be inhibited by targeting nucleotide sequences complementary to the regulatory region of the LRP5 or HBM gene (e.g., the LRP5 or HBM gene promoter and/or enhancers) to form triple helical structures that prevent transcription of the LRP5 HBM gene in target cells. See generally, Helene, C. (1991) *Anticancer Drug Des.* 6(6):569-84; Helene, C. et al. (1992) *Ann. N.Y. Acad Sci.* 660:27-36; and Maher, L. J. (1992) *Bioassays* 14(12):807-15. LRP5 or HBM gene expression can also be inhibited using RNA interference (RNAi). This is a technique for post-transcriptional gene silencing (PTGS), in which target gene activity is specifically abolished with cognate double-stranded RNA (dsRNA). RNAi resembles in many aspects PTGS in plants and has been detected in many invertebrates including trypanosome, hydra, planaria, nematode and fruit fly (*Drosophila melanogaster*). It may be involved in the modulation of transposable element mobilizaiton and antiviral state formation. RNAi in mammalian systems is disclosed in PCT application WO 00/63364 which is incorporated by reference herein in its entirety. Basically, dsRNA, homologous to the target (LRP5 or HBM) is introduced into the cell and a sequence specific reduction in gene activity is observed. Both small and interfering RNAs (siRNAs) and short hairpin RNAs (shRNAs) are contemplated. See for example Yu et al., (2002) *PNAS*, 99, 6047-6052; Paddison et al., (2002) *Genes and Development*, 16, 948-58; Brummelkamp et al., (2002) *Science* 296, 550-553; Tuschl, (2002) *Nature Biotechnology* 20, 446-448; and, references therein.

As an example, preparing antisense oligonucleotides can be performed as follows. Studies have been undertaken using antisense technology in the osteoblast-like murine cell line, MC3T3. These cells can be triggered to develop along the bone differentiation sequence. An initial proliferation period is characterized by minimal expression of differentiation markers and initial synthesis of collagenous extracellular matrix. Collagen matrix synthesis is required for subsequent induction of differentiation markers. Once the matrix synthesis begins, osteoblast marker genes are activated in a clear temporal sequence: alkaline phosphatase is induced at early times while bone sialoprotein and osteocalcin appear later in the differentiation process. This temporal sequence of gene expression is useful in monitoring the maturation and mineralization process. Matrix mineralization, which does not begin until several days after maturation has started, involves deposition of mineral on and within collagen fibrils deep within the matrix near the cell layer-culture plate interface. The collagen fibril-associated mineral formed by cultured osteoblasts resembles that found in woven bone in vivo and therefore is used frequently as a study reagent.

MC3T3 cells were transfected with antisense oligonucleotides for the first week of the differentiation, according to the manufacturer's specifications (U.S. Pat. No. 5,849,902).

The oligonucleotides designed for LRP5 (Zmax1) are given below (SEQ ID NOS:639-641):

```
10875: AGUACAGCUUCUUGCCAACCCAGUC

10876: UCCUCCAGGUCGAUGGUCAGCCCAU

10877: GUCUGAGUCCGAGUUCAAAUCCAGG
```

FIG. 13 shows the results of antisense inhibition of LRP5 in MC3T3 cells. The three oligonucleotides shown above were transfected into MC3T3 and RNA was isolated according to standard procedures. Northern analysis clearly shows markedly lower steady state levels of the LRP5 transcript while the control gene GAPDH remained unchanged. Thus, antisense technology using the primers described above allows for the study of the role of LRP5 expression on bone biology.

XVI. Yeast Two Hybrid

In order to identify the signaling pathway that LRP5 participates in to modulate bone density, the yeast two hybrid protein interaction technology was utilized. This technique facilitates the identification of proteins that interact with one another by coupling tester proteins to components of a yeast transcription system (Fields and Song, 1989, *Nature* 340: 245-246; U.S. Pat. No. 5,283,173 by Fields and Song; Johnston, 1987, *Microbiol. Rev.* 51: 458-476; Keegan et al., 1986, *Science* 231: 699-704; Durfee et al., 1993, *Genes Dev.* 7: 555-569; Chien et al., 1991, *Proc. Natl. Acad. Sci USA* 88: 9578-9582; Fields et al., 1994, *Trends in Genetics* 10: 286-292; and Gyuris et al., 1993, *Cell* 75: 791-803). First a "bait" protein, the protein for which one seeks interacting proteins, is fused to the DNA binding domain of a yeast transcription factor. Second, a cDNA library is constructed that contains cDNAs fused to the transcriptional activation domain of the same yeast transcription factor; this is termed the prey library. The bait construct and prey library are transformed into yeast cells and then mated to produce diploid cells. If the bait interacts with a specific prey from the cDNA library, the activation domain is brought into the vicinity of the promoter via this interaction. Transcription is then driven through selectable marker genes and growth on selective media indicates the presence of interacting proteins.

The amino acid sequence used in the yeast two hybrid experiments discussed herein consisted of the entire cytoplasmic domain and a portion of the transmembrane domain and is shown below (amino to carboxy orientation) (SEQ ID NO:765):

```
RVVCQRYAGA NGPFPHEYVS GTPHVPLNFI APGGSQHGPF

TGIACGKSMM SSVSLMGGRG GVPLYDRNHV TGASSSSSSS

TKATLYPPIL NPPPSPATDP SLYNMDMFYS SNIPATVRPY

RPYIIRGMAP PTTPCSTDVC DSDYSASRWK ASKYYLDLNS

DSDPYPPPPT PHSQYLSAED SCPPSPATER

SYFHLFPPPP SPCTDSS
```

The last 6 amino acids of the putative transmembrane domain are indicated in bold. Putative SH3 domains are underlined. Additional amino acid sequences of 50 amino acids or greater in either the proteins encoded by the LRP5 or HBM alleles can also be used as bait. The upper size of the polypeptide used as bait is limited only by the presence of a complete transmembrane domain (see FIG. 4), which will render the bait to be nonfunctional in a yeast two hybrid system. These additional bait proteins can be used to identify additional proteins which interact with the proteins encoded by HBM or LRP5 in the focal adhesion signaling pathway or in other pathways in which these HBM or LRP5 proteins may act. Once identified, methods of identifying agents which regulate the proteins in the focal adhesion signaling pathway or other pathways in which HBM acts can be performed as described herein for the HBM and LRP5 proteins.

In order to identify cytoplasmic LRP5 signaling pathways, the cytoplasmic domain of LRP5 was subcloned into two bait vectors. The first vector was pDBleu, which was used to screen a brain, and Hela prey cDNA library cloned into the vector pPC86 (Clontech). The second bait vector used was pDBtrp, which was used to screen a cDNA prey library derived from the TE85 osteosarcoma cell line in vector pOP46. Another suitable vector which is widely available, is p86 (Gibco, iest™ System). Standard techniques known to those skilled in the art were used as described in Fields and Song, 1989, *Nature* 340: 245-246; U.S. Pat. No. 5,283,173 by Fields and Song; Johnston, 1987, *Microbiol. Rev.* 51: 458-476; Keegan et al., 1986, *Science* 231: 699-704; Durfee et al., 1993, *Genes Dev.* 7: 555-569; Chien et al., 1991, *Proc. Natl. Acad. Sci USA* 88: 9578-9582; Fields et al., 1994, *Trends in Genetics* 10: 286-292; and Gyuris et al., 1993, *Cell* 75: 791-803. The bait construct and prey cDNA libraries were transformed into yeast using standard procedures.

To perform the protein interaction screen, an overnight culture of the bait yeast strain was grown in 20 ml SD selective medium with 2% glucose (pDBLeu, SD -Leu medium, pDBtrp, SD -trp medium). The cultures were shaken vigorously at 30° C. overnight. The cultures were diluted 1:10 with complete medium (YEPD with 2% glucose) and the cultures then incubated with shaking for 2 hrs at 30° C.

The frozen prey library was thawed, and the yeast cells reactivated by growing them in 150 ml YEPD medium with 2% glucose for 2 hrs at 30° C. A filter unit was sterilized with 70% ethanol and washed with sterile water to remove the ethanol. The cell densities of both bait and prey cultures were measured by determining the OD at 600 nm. An appropriate volume of yeast cells that corresponded to a cell number of 1 ml of OD 600=4 of each yeast strain, bait and prey (library) was placed in a 50 ml Falcon tube. The mixture was then filtered through the sterilized filter unit. The filter was then transferred onto a prewarmed YEPD agar plate with the cell side up, removing all air bubbles underneath the filter. Plates were then incubated at 30° C. for 6 hrs. One filter was transferred into a 50 ml Falcon tube, and 10 ml of SD with 2% Glucose was added; cells were resuspended by vortexing for 10 sec.

The number of primary diploid cells (growth on SD -Leu, -Trp plates) versus the numbers of colony forming units growing on SD -Trp and SD -Leu plates only was then titered. Different dilutions were plated and incubated at 30° C. for two days. The number of colony forming units was then counted. The number of diploid colonies (colonies on SD -Leu -Trp plates) permits the calculation of whether or not the whole library of prey constructs was mated to the yeast expressing the bait. This information is important to judge the quality of the screen.

A. Indirect Selection

Resuspended cells from 5 filtermatings were then pooled and the cells sedimented by centrifugation in a 50 ml Falcon tube. Cells were then resuspended in 16 ml SD medium with 2% Glc. Two ml of this cell suspension was plated onto 8 square plates each (SD -Leu, -Trp) with sterile glass beads and selected for diploid cells by incubating at 30° C. for 18-20 hrs.

Cells were then scraped off the square plates, the cells centrifuged and combined into one 50 ml Falcon tube. The cell pellet was then resuspended in 25 ml of SD medium with 2% glucose. The cell number was then determined by counting of an appropriate dilution (usually 1:100 to 1:1000) with a Neugebauer chamber. Approximately $5 \times 10^7$ diploid cells were plated onto the selective medium. The observations about the growth of the bait strain together with irrelevant prey vectors helps to determine which selective plates will have to be chosen for the library screen. Generally, all screens were plated on one square plate each with SD -Leu, -Trp, -His; SD -Leu, -Trp, His, 5 mM 3AT, and SD -Leu, -Trp, -His, -Ade is recommended.

The yeast cells were then spread homogeneously with sterile glass beads and incubated at 30° C. for 4 days. The number of colony forming yeast cells was titered by plating different dilutions of the scraped cell suspension onto SD -Leu, -Trp plates. Usually, plating of 100 µl of a $10^{-3}$ and $10^{-4}$ dilution gave 100-1000 colonies per plate.

B. Direct Selection

Five filters with the mated yeast cells were each transferred into separate 50 ml Falcon tubes and the cells resuspended with 10 ml SD medium with 2% Glc, each, followed by vortexing for 10 sec. The resuspended cells were combined and centrifuged in a Beckman centrifuge at 3000 rpm. The supernatant was discarded and the cells resuspended in 6 ml of SD medium with 2% Glc. Two ml of the suspension was spread onto each selective square plate and incubated at 30° C. for 4-5 days.

C. Isolation of Single Colonies

Yeast cells from an isolated colony were picked with a sterile tooth pick and transferred into individual wells of a 96 well plate. The cells were resuspended in 50 µl of SD -Leu, -Trp, -His medium and incubated at 30° C. for one day. The yeast cells were then stamped onto a SD -Leu, -Trp, -His plate in 96 well format and incubated at 30° C. for 2 days. Yeast cells were also stamped onto a Nylon filter covering a YEPD plate and incubated at 30° C. for one day. The cells on the Nylon filter were used for the analysis of the β-Gal reporter activity.

Yeast colonies were scraped from the SD -Leu, -Trp, -His plate with a sterile tooth pick, and reconfigured, if necessary, according to the β-Gal activity and then resuspended in 20% glycerol. This served as a master plate for storage at −80° C.

For DNA preparation, yeast cells from the glycerol stock were stamped onto a SD -Trp plate and incubated at 30° C. for 2 days. After two days of incubation, the yeast colonies were ready for colony PCR and sequencing. Standard colony PCR conditions were used to amplify inserts from preys recovered from the interaction screen. Sequencing was done using standard sequencing reactions and ABI377 (Perkin Elmer) fluorescent sequencing machines.

D. Verification of Bait/Prey Interaction

Glycerol stocks of the prey of interest were thawed and inoculated in a 10 ml overnight culture of SD with glucose -Trp. After overnight growth, plasmid DNA preparation was performed using the BIO 101 RPM Yeast Plasmid Isolation Kit with 10 ml of culture. The culture was centrifuged and transferred to a 1.5 ml microcentrifuge tube. Yeast Lysis Matrix was then added to the pellet followed by 250 µl of Alkaline Lysis Solution. Samples were then vortexed for 5 minutes. 250 µl Neutralizing Solution was added and the sample mixed briefly. Samples were centrifuged for 2 minutes at room temperature in a microcentrifuge. The supernatant was transferred to a Spin Filter avoiding debris and Lysis Matrix. 250 µl of Glassmilk Spin Buffer was added, and the tubes inverted to mix. Samples were centrifuged for 1 min and the liquid in the Catch Tube was discarded. 500 µl of Wash Solution was added, the samples were centrifuged for 1 min, and the wash solution was discarded. The wash step was repeated once followed by a 1 min dry centrifugation to drive the remaining liquid out of the Spin Filter. The filter was transferred to a new Catch Tube and 100 µl of sterile $H_2O$ was added; samples were then vortexed briefly to resuspend and centrifuged for 30 seconds to collect the DNA in the bottom of the Catch Tube.

Five µl of DNA was then transformed into DH10B Electromax cells using standard procedures and glycerol stocks prepared. Miniprep DNA was prepared using the Qiagen QIAprep Spin Miniprep Kit. DNA was finally eluted with 30 µl of Qiagen EB buffer. One µl of the plasmid DNA samples was then used to transform yeast cells using standard procedures. After 2 days of growth on SD -trp media, colonies were picked and patched onto fresh media. Similarly, bait colonies were patched onto SD -Leu media. Both were grown overnight at 30° C.

For mating, cells from bait and prey patches were spread together on YAPD media and incubated at 30° C. for 12 hr. This plate was then replicaplated onto an SD Agar-Leu-Trp plate and grown for 2 days at 30° C. To test the strength of interaction these plates were replicaplated onto SD Agar-Leu-Trp-His, SD Agar-Leu-Trp-His with 5 mM 3AT and 10 mM 3AT, SD Agar-Leu-Trp-His-Ade, and SD Agar-Leu-Trp-Ura media and grown for 2 days at 30° C.

E. Galacton Star β-Galactosidase Activity Assay

After streaking and replica plating positive interactors on selection plates, colonies were placed in a 96 well dish with 200 µl of SD-medium, leaving wells 1 and 96 blank. Ten microliters from the first 96 well dish was plated into another flat bottom 96 well dish containing 100 µl of SD-medium. Controls consisted of a negative control and a very weak positive control. The cell density was measured at $OD_{600}$ (a value of 1 corresponds to $1\times10^7$ cells utilizing a 96 well spectrophotometer). The OD was usually between 0.03 and 0.10. Using microplates specifically for the luminometer, 50 µl of reaction mixture were pipetted into each well. Fifty microliters of culture were then added and mixed by pipetting up and down twice. The reaction was incubated for 30 minutes at room temperature followed by measurement of Relative Light Units using a luminometer.

Table 6 lists the genes identified in the yeast two hybrid screens from the 3 prey libraries tested. Two genes, zyxin and axin, were found to interact with the cytoplasmic domain of LRP5 in all three screens. Three genes, alpha-actinin, TCB and S1-5 interacted in two of the three screens.

A variety of proteins found at sites of cell-cell and cell-matrix contact (focal contacts/adesion plaques) were shown to interact with the cytoplasmic domain of LRP5. These include alpha-actinin, Trio, Pinch-like protein, and Zyxin. PINCH is a LIM domain-containing protein that is known to interact with integrin-linked kinase, an early signaler in integrin and growth factor signaling pathways. The finding of a closely related gene in the yeast two hybrid screen raises the possibility of a novel pathway linked to integrin signaling from extracellular matrix signals. Trio, also known to localize to focal adhesions, is thought to play a key role in coordinating cell-matrix interactions and cytoskeletal rearrangements involved in cell movement. Zyxin, another LIM domain-containing protein, is also localized to adhesion plaques and is thought to be involved in reorganization of the cytoskeleton when triggers are transmitted via integrin signaling pathways. Zyxin also interacts with alpha actinin, which we identified as interacting with LRP5. Other LIM domain containing proteins identified include the human homologue of mouse ajuba, LIMD1, and a novel LIMD1-like protein.

Axin was also identified from the two hybrid experiments. This protein is involved in inhibition of the Wnt signaling pathway and interacts with the tumor suppressor APC. There is a link here with the focal adhesion signaling described above: one common step in the two pathways involves inhibition of glycogen synthase kinase 3, which in turn results in the activation of β-catenin/Lef-1 and AP-1 transcription factors. Axin/APC are involved in this as well as integrin linked kinase. The Wnt pathway has a role in determining cell fates during embryogenesis. If inappropriately activated, the Wnt pathway may also lead to cancer. The Wnt pathway also seems to have a role in cytoskeletal rearrangements. In a Xenopus embryo assay, the combination of HBM and Wnt5a preoteins stimulated the Wnt pathway to a much greater extent than the combination of LRP5 and Wnt5a, which was modestly above the control and Wnt5a alone scores. The HBM and LRP5 extracellular domains (ECD) caused a modest stimulation of Wnt signaling in the absence of Wnt5a which was slightly increased by the presence of Wnt5a in the presence of HBM ECD. A model depicting LRP5 involvement in focal adhesion signaling is depicted in FIG. 15.

This data coupled with other studies suggest that integrin signaling pathways have a role in cellular responses to mechanical stress and adhesion. This provides an attractive model for the mechanism of action of LRP5 in bone biology. It is possible that LRP5 is involved in sensing either mechanical stress directly or binding a molecule in the extracellular matrix that is related to mechanical sensation. Signaling through subsequent pathways may be involved in bone remodeling due to effects on cell morphology, cell adhesion, migration, proliferation, differentiation, and apoptosis in bone cells.

TABLE 6

Yeast Two Hybrid Results

| Gene Symbol | Gene | Genbank Accession # | NT SEQ ID NO: | AA SEQ ID NO: |
|---|---|---|---|---|
| ACTN1 | alpha-actinin | NM_001102 | 642 | |
| AES | amino-terminal enhancer of | NM_001130. | 643 | |
| AIP4 | atrophin-1 interacting protein | AF038564.1 | 644 | |
| Novel | Ajuba | | 645 | |
| AXIN | Wnt signaling | AF009674.1 | 646 | |
| CDC23 | cell division cycle 23, yeast, | NM_004661. | 647 | |
| HSM800944 | Similar to TRIO | AL117435.1 | 648 | |
| HSM800936 | | AL117427.1 | 649 | |
| Novel | Similar to LIM domains | | 650 | |
| DEEPEST | mitotic spindle coiled-coil | NM_006461. | 651 | |
| ECM1 | extracellular matrix protein 1 | U65932.1 | 652 | |
| EF1A | elongation factor 1-alpha | X16869.1 | 653 | |
| FN | fibronectin | X02761.1 | 654 | |
| HOXB13 | homeodomain protein | U81599.1 | 655 | |
| Novel | Glu-Lys Rich protein | | 656 | |
| LIMD1 | LIM domains containing 1 | NM_014240. | 567 | |
| Novel | PINCH-like | | 568 | |
| RANBPM | centrosomal protein | NM_005493. | 659 | |
| S1-5 | extracellular protein | U03877.1 | 660 | |
| TCB | gene encoding cytosolic | M26252.1 | 661 | |
| TID | tumorous imaginal discs | NM_005147. | 662 | |
| ZYX | Zyxin | NM_003461. | 663 | |
| TRIO | GTPase | U42390.1 | 664 | |
| HUMPITPB | phosphatidylinositol transfer | D30037.1 | 665 | |
| ACTN1 | alpha-actinin | NP_001093.1 | | 666 |
| AES | amino-terminal enhancer of | NP_001121.2 | | 667 |
| AIP4 | atrophin-1 interacting protein | AAC04845.1 | | 668 |
| Novel | Ajuba | | | 669 |
| AXIN | Wnt signalling | AAC51624.1 | | 670 |
| CDC23 | cell division cycle 23, yeast | NP_004652.1 | | 671 |
| Novel | Similar to TRIO CAB55923.1 | | | 672 |
| Novel | Similar to LIM domains | | | 673 |
| DEEPEST | mitotic spindle coiled-coil | NP_006452.1 | | 674 |
| ECM1 | extracellular matrix protein 1 | AAB05933.1 | | 675 |
| EF1A | elongation factor 1-alpha | CAA34756.1 | | 676 |
| FN | fibronectin | CAA26536.1 | | 677 |
| Novel | Glu-Lys rich protein | | | 678 |
| HOXB13 | homeodomain protein B13 | AAB39863.1 | | 679 |
| LIMD1 | LIM domains containing 1 | NP_055055.1 | | 680 |
| Novel | PINCH-like | | | 681 |
| RANBPM | centrosomal protein | NP_005484.1 | | 682 |
| S1-5 | extracellular protein | AAA65590.1 | | 683 |
| TCB | cytosolic thyroid hormone- | AAA36672.1 | | 684 |
| TID | tumorous imaginal discs | NP_005138.1 | | 685 |
| ZYX | Zyxin | NP_003452.1 | | 686 |
| TRIO | GTPase | AAC34245.1 | | 687 |
| PTDINSTP | phosphatidylinositol transfer | P48739 | | 688 |

In light of the model depicted in FIG. 15 and the results shown in Table 6, another aspect contemplated by the invention would be to regulate bone density and bone mass disorders by the regulating focal adhesion signaling. The regulation can occur by regulating the DNA, mRNA transcript or protein encoded by any of the members involved in the focal adhesion signaling pathway as identified by the yeast two hybrid system.

Also contemplated are the novel nucleic acids and proteins identified by the HBM yeast two hybrid system. These include but are not limited to SEQ ID NO: 645 (Ajuba), SEQ ID NO: 651 (a gene similar to a gene encoding LIM domains containing protein 1), SEQ ID NO: 656 (Glu-Lys Rich protein), SEQ ID NO: 658 (PINCH-like gene), SEQ ID NO: 669 (Ajuba protein), SEQ ID NO: 672 (protein similar to TRIO), SEQ ID NO: 673, SEQ ID NO: 678 (Glu-Lys rich protein) and SEQ ID NO: 681 (PINCH-like protein).

XVII. LRP5/LRP6 and HBM Function

Recent studies have indicated that LRP5 participates in the Wnt signal transduction pathway. Gong et al. have also recently published results which further support the role of LRP5 in bone development (Gong et al., *Cell*, 107:513-23, 2001). The study by Gong and co-workers describes mutations of LRP5 which cause the autosomal recessive disorder osteoporosis-pseudoglioma syndrome (OPPG). They conclude that OPPG is caused by loss of LRP5 function and implicate LRP6 as a redundant receptor in the Wnt pathway. Loss of LRP5 function has recently been shown to result in a low bone mass phenotype. (Kato et al., *J. Cell. Biol.*, 157: 303-14 (2002)).

The Wnt pathway is critical in limb early embryological development. Nusse, *Nature* 411:255-6 (2001); and Mao et al., *Nature* 411:321-5 (2001)). Wnt proteins are secreted proteins which interact with the transmembrane protein Frizzled (Fz). LRP proteins, such as LRP5 and LRP6, are believed to modulate the Wnt signal in a complex with Fz (Tamai et al., Nature 407:530-5 (2000)). The Wnt pathway acts intracellularly through the Disheveled protein (Dsh) which in turn inhibits glycogen synthetase kinase-3 (GSK3) from phosphorylating β-catenin. Phosphorylated β-catenin is rapidly degraded following ubiquitination. However, the stabilized β-catenin accumulates and translocates to the nucleus where it acts as a cofactor of the T-cell factor (TCF) transcription activator complex.

The protein dickkopf-1 (Dkk-1) is an antagonist of the Wnt pathway required for head formation in early development. (Glinka et al., Nature, 391:357-62 (1998)) Dkk-1 and its function in the Wnt pathway are described in e.g., Krupnik, et al., Gene 238:301-13 (1999); Fedi et al., J. Biol. Chem. 274: 19465-72 (1999); see also for Dkk-1 and the Wnt pathway, Wu et al., Curr. Biol. 10:1611-4 (2000), Shinya et al., Mech. Dev. 98:3-17 (2000), Mukhopadhyay et al., Dev Cell 1:423-434 (2001) and in PCT Patent Application No. WO 00/52047, and in references cited in each. It has been known that Dkk-1 acts upstream of Dsh, however the nature of the mechanism of inhibition by Dkk-1 is just beginning to be elucidated. Dkk-1 is expressed in the mouse embryonic limb bud and its disruption results in abnormal limb morphogensis, among other developmental defects (Gotewold et al., Mech. Dev. 89:151-3 (1999); and, Mukhopadhyay et al., Dev Cell 1:423-434 (2001)).

The interaction between Dkk-1 and LRP5 was discovered by a yeast two hybrid (Y2H) screen for proteins which interact with the ligand binding domain of LRP5 in experiments disclosed by the present inventors in U.S. Applications 60/291,311 filed May 17, 2001; 60/353,058 filed Feb. 1, 2002, and 60/361,293 filed Mar. 4, 2002. The two-hybrid screen is a common procedure in the art, which is described, for example, by Gietz et al., Mol. Cell. Biochem. 172:67-79 (1997); Young, Biol. Reprod. 58:302-11 (1998); Brent and Finley, Ann. Rev. Genet. 31:663-704 (1997); and Lu and Hannon, eds., Yeast Hybrid Technologies, Eaton Publishing, Natick Mass., (2000). More recently, other studies confirm that Dkk-1 is a binding partner for LRP and modulates the Wnt pathway via direct binding with LRP (R. Nusse, Nature 411:255-256 (2001); A. Bafico et al., Nat. Cell Biol. 3:683-686 (2001); M. Semënov, Curr. Biol. 11:951-961 (2001); B. Mao, Nature 411:321-325 (2001), Zorn, Curr. Biol. 11:R592-5 (2601)); and, L. Li et al., J. Biol Chem. 277:5977-81 (2002)).

Mao and colleagues (2001) identified Dkk-1 as a ligand for LRP6 and suggest that Dkk-1 and LRP6 interact antagonistically in that Dkk proteins inhibit the Wnt coreceptor functions of LRP6. Using co-immunoprecipitation, the group verified that the Dkk-1/LRP6 interaction was direct. Dkk-2 was also found to directly bind LRP6. However, Mao et al. report that no interaction was detected between any Dkk protein and LRP5 nor do they find an interaction with LDLR, VLDLR, ApoER, or LRP. Additionally, Mao et al. demonstrated that LRP6 can titrate Dkk-1's effects of inhibiting Wnt signaling using the commercial TCF-luciferase reporter gene assay (TOPFLASH). A similar conclusion was drawn from analogous studies in Xenopus embryos. Deletion analysis of LRP6 functional domains revealed that EGF repeats (beta-propellers) 3 and 4 were necessary for Dkk-1 binding and that the ligand binding domains of LRP6 had no effect on Dkk-1 binding. The findings of Mao et al. contrast with data obtained by the present inventors indicating that the ligand binding domains of LRP5 were necessary and sufficient for Dkk-1 binding in yeast. Using classical biochemical ligand-receptor studies, Mao et al. determined a Kd=0.34 nM for Dkk-1/LRP6 and a Kd=0.73 nM for Dkk-2/LRP6.

Semenov et al. (2001) verified the Mao group's results and confirmed by coimmunoprecipitation that Dkk-1 does not directly bind to Wnt or Frizzled but rather interacts with LRP6. Their Scatchard analysis found Kd=0.5 nM for Dkk-1/LRP6. Semenov et al. also demonstrated that Dkk-1 could abolish an LRP5/Frizzled8 complex implying that Dkk-1 can also repress Wnt signaling via interactions with LRP5. A Dkk-1 mutant having cysteine 220 changed to alanine abolished LRP6 binding and was unable to repress Wnt signaling. Studies in Xenopus embryos confirmed the results and revealed a functional consequence of Dkk-1/LRP6: repression of Wnt signaling. Their Xenopus work also suggested that LRP6/Dkk-1 may be specific for the canonical, β-catenin-mediated, Wnt pathways as opposed to the Wnt Planar Cell Polarity pathway.

Bafico et al. (2001) employed a $^{125}$I-labeled Dkk-1 molecule to identify LRP6 as its sole membrane receptor with a Kd=0.39 nM. Again, the functional consequences of the Dkk-1/LRP6 interaction was a repression of the canonical Wnt signaling even when Dkk-1 was added at extremely low concentrations (30 pM).

Dkk-1 is able to repress LRP5-mediated Wnt signaling but is less effective in repressing HBM-mediated Wnt signaling as first disclosed by the present inventors in U.S. Applications 60/291,311 filed May 17, 2001; 60/353,058 filed Feb. 1, 2002, and 60/361,293 filed Mar. 4, 2002. This observation is of particular interest because the HBM mutation in LRP5 is a gain of function or activation mutation. That is, Wnt signaling, via the canonical pathway, is enhanced with HBM versus LRP5. Not wishing to be bound by theory, it is believed that this interaction provides an explanation of the developmental signaling differences between HBM and the more common LRP5/LRP6.

Further investigations of additional Wnt or Dkk family members show subtle differences in activities through the Wnt pathway and demonstrate the complexity and variability in Wnt signaling that can be achieved as a function of the LRP/Dkk/Wnt/Frizzled repertoire that is expressed in a particular cell or tissue. This may attest to the apparent bone specificity of the HBM phenotype in humans and in the HBM transgenic animals. These subtle variations should be considered in the development of potential therapies and or drug interventions. It is desirable more precisely control LRP5 signaling than to simply turn it on or off.

It may be that the reduced effectiveness of Dkk inhibition of LRP5 which is observed for HBM is not necessarily mediated by enhancing or preventing the binding of Dkk to LRP5/LRP6/HBM. More than one mechanism may be involved. Indeed, the inventors have observed that Dkk-1 binds LRP5, LRP6, and HBM. Further, it has been observed that different members of the Dkk family differentially affect LRP5/LRP6/HBM activity. Rather, the more preferred approach is to develop a drug or therapy which results in the desired protective benefits by reproducing as nearly as possible the subtle effect of HBM. The ability to refine and test potential drugs and therapies by comparing their effects to an animal model of HBM is among the major features of the present invention.

The transgenic animals and methods of the invention may be utilized to screen potential therapeutic compounds and methods in the context of an animal model of the HBM phenotype. As such the animals and methods of the invention represent an invaluable tool in the development of future drugs and therapies. The present invention provides important research tools to develop an effective model of osteoporosis, to increase understanding of bone mass and lipid modulation, and to modulate bone mass an lipid metabolism.

The protein encoded by LRP5 is structurally related to the Low Density Lipoprotein receptor (LDL receptor). See, Goldstein et al., *Ann. Rev. Cell Biology*, 1:1-39 (1985); Brown et al., *Science*, 232:34-47 (1986). The LDL receptor is responsible for uptake of low density lipoprotein, a lipid-protein aggregate that includes cholesterol. Individuals with a defect in the LDL receptor are deficient in cholesterol removal and tend to develop arteriosclerosis. In addition, cells with a defective LDL receptor show increased production of cholesterol, in part because of altered feedback regulation of cholesterol synthetic enzymes and in part because of increased transcription of the genes for these enzymes. In some cell types, cholesterol is a precursor for the formation of steroid hormones. Thus, the LDL receptor may also function as an indirect signal transduction protein and may regulate gene expression.

The glycine 171 amino acid is likely to be important for the function of LRP5 because this amino acid is also found in the mouse homolog of LRP5. The closely related LRP6 (Genbank Accession No. JE0272) protein also contains glycine at the corresponding position (Brown et al., *Biochemical and Biophysical Research Comm.*, 248:879-888 (1988)). Amino acids that are important in a protein's structure or function tend to be conserved between species, because natural selection prevents mutations with altered amino acids at important positions from arising.

In addition, the extracellular domain of LRP5 contains four repeats consisting of five YWTD motifs followed by an EFG motif. This 5YWTD+EGF repeat is likely to form a distinct folded protein domain, as this repeat is also found in the LDL receptor and other LDL receptor-related proteins. The first three 5YWTD+EGF repeats are very similar in their structure, while the fourth is highly divergent. Glycine 171 occurs in the central YWTD motif of the first 5YWTD+EGF repeat in LRP5. The other two similar 5YWTD+EGF repeats of LRP5 also contain glycine at the corresponding position, as does the 5YWTD+EGF repeat in the LDL receptor protein. However, only 17.6% of the amino acids are identical among the first three 5YWTD +EGF repeats in LRP5 and the single repeat in the LDL receptor. These observations indicate that glycine 171 is essential to the function of this repeat, and mutation of glycine 171 causes a functional alteration of LRP5. The cDNA and peptide sequences are shown in FIGS. 6A-6J. The critical base at nucleotide position 582 is indicated in bold and is underlined.

Northern blot analysis (FIGS. 7A-B) reveals that LRP5 is expressed in human bone tissue as well as numerous other tissues. A multiple-tissue Northern blot (Clontech, Palo Alto, Calif.) was probed with exons from LRP5. As shown in FIG. 7A, the 5.5 kb LRP5 transcript was highly expressed in heart, kidney, lung, liver and pancreas and is expressed at lower levels in skeletal muscle and brain. A second northern blot, shown in FIG. 7B, confirmed the transcript size at 5.5 kb, and indicated that LRP5 is expressed in bone, bone marrow, calvaria and human osteoblastic cell lines.

Taken together, these results coupled with the yeast two hybrid results indicate that the HBM polymorphism in the LRP5 gene is responsible for the HBM phenotype, and that the LRP5 gene is important in bone development. In addition, because mutation of LRP5 can alter bone mineralization and development, it is likely that molecules that bind to LRP5 may usefully alter bone development. Such molecules may include, for example, small molecules, proteins, RNA aptamers, peptide aptamers, and the like.

XVIII. Preparation of Nucleic Acids, Vectors, Transformations and Host Cells

Large amounts of the nucleic acids of the present invention may be produced by replication in a suitable host cell. Natural or synthetic nucleic acid fragments coding for a desired fragment will be incorporated into recombinant nucleic acid constructs, usually DNA constructs, capable of introduction into and replication in a prokaryotic or eukaryotic cell. Usually the nucleic acid constructs will be suitable for replication in a unicellular host, such as yeast or bacteria, but may also be intended for introduction to (with and without integration within the genome) cultured mammalian or plant or other eukaryotic cell lines. The purification of nucleic acids produced by the methods of the present invention is described, for example, in Sambrook et al., *Molecular Cloning. A Laboratory Manual*, 2nd Ed. (Cold Spring Harbor Laboratory, Cold Spring Harbor, N.Y. (1989) or Ausubel et al., *Current Protocols in Molecular Biology*, J. Wiley and Sons, NY (1992).

The nucleic acids of the present invention may also be produced by chemical synthesis, e.g., by the phosphoramidite method described by Beaucage et al., *Tetra. Letts.*, 22:1859-1862 (1981) or the triester method according to Matteucci,et al., *J. Am. Chem. Soc.*, 103:3185 (1981), and may be performed on commercial, automated oligonucleotide synthesizers. A double-stranded fragment may be obtained from the single-stranded product of chemical synthesis either by synthesizing the complementary strand and annealing the strands together under appropriate conditions or by adding the complementary strand using DNA polymerase with an appropriate primer sequence.

Nucleic acid constructs prepared for introduction into a prokaryotic or eukaryotic host may comprise a replication system recognized by the host, including the intended nucleic acid fragment encoding the desired protein, and will preferably also include transcription and translational initiation regulatory sequences operably linked to the protein encoding segment. Expression vectors may include, for example, an origin of replication or autonomously replicating sequence (ARS) and expression control sequences, a promoter, an enhancer and necessary processing information sites, such as ribosome-binding sites, RNA splice sites, polyadenylation sites, transcriptional terminator sequences, and mRNA stabilizing sequences. Secretion signals may also be included where appropriate, whether from a native HBM or LRP5 protein or from other receptors or from secreted proteins of the same or related species, which allow the protein to cross and/or lodge in cell membranes, and thus attain its functional topology, or be secreted from the cell. Such vectors may be prepared by means of standard recombinant techniques well known in the art and discussed, for example, in Sambrook et al., *Molecular Cloning. A Laboratory Manual*, 2nd Ed. (Cold Spring Harbor Laboratory, Cold Spring Harbor, N.Y. (1989) or Ausubel et al., *Current Protocols in Molecular Biology*, J. Wiley and Sons, NY (1992).

An appropriate promoter and other necessary vector sequences will be selected so as to be functional in the host, and may include, when appropriate, those naturally associated with LRP5 or HBM genes. Examples of workable combinations of cell lines and expression vectors are described in Sambrook et al., *Molecular Cloning. A Laboratory Manual*, 2nd Ed. (Cold Spring Harbor Laboratory, Cold Spring Harbor, N.Y. (1989) or Ausubel et al., *Current Protocols in Molecular Biology*, J. Wiley and Sons, NY (1992). Many useful vectors are known in the art and may be obtained from such vendors as Stratagene, New England BioLabs, Promega Biotech, and others. Promoters such as the trp, lac and phage promoters, tRNA promoters and glycolytic enzyme promoters may be used in prokaryotic hosts. Useful yeast promoters include promoter regions for metallothionein, 3-phosphoglycerate kinase or other glycolytic enzymes such as enolase or glyceraldehyde-3-phosphate dehydrogenase, enzymes responsible for maltose and galactose utilization, and others. Vectors and promoters suitable for use in yeast expression are further described in EP 73,675A. Appropriate non-native mammalian promoters might include the early and late promoters from SV40 (Fiers et al., *Nature*, 273:113 (1978)) or promoters derived from murine Moloney leukemia virus, mouse tumor virus, avian sarcoma viruses, adenovirus II, bovine papilloma virus or polyoma. In addition, the construct may be joined to an amplifiable gene (e.g., DHFR) so that multiple copies of the gene may be made. For appropriate enhancer and other expression control sequences, see also *Enhancers and Eukaryotic Gene Expression*, Cold Spring Harbor Press, Cold Spring Harbor, N.Y. (1983).

While such expression vectors may replicate autonomously, they may also replicate by being inserted into the genome of the host cell, by methods well known in the art.

Expression and cloning vectors will likely contain a selectable marker, a gene encoding a protein necessary for survival or growth of a host cell transformed with the vector. The presence of this gene ensures growth of only those host cells which express the inserts. Typical selection genes encode proteins that a) confer resistance to antibiotics or other toxic substances, e.g. ampicillin, neomycin, methotrexate, etc.; b) complement auxotrophic deficiencies, or c) supply critical nutrients not available from complex media, e.g., the gene encoding D-alanine racemase for Bacilli. The choice of the proper selectable marker will depend on the host cell, and appropriate markers for different hosts are well known in the art.

The vectors containing the nucleic acids of interest can be transcribed in vitro, and the resulting RNA introduced into the host cell by well-known methods, e.g., by injection (see, Kubo et al., *FEBS Letts*. 241:119 (1988)), or the vectors can be introduced directly into host cells by methods well known in the art, which vary depending on the type of cellular host, including electroporation; transfection employing calcium chloride, rubidium chloride, calcium phosphate, DEAE-dextran, or other substances; microprojectile bombardment; lipofection; infection (where the vector is an infectious agent, such as a retroviral genome); and other methods. See generally, Sambrook et al., 1989 and Ausubel et al., 1992. The introduction of the nucleic acids into the host cell by any method known in the art, including those described above, will be referred to herein as "transformation." The cells into which have been introduced nucleic acids described above are meant to also include the progeny of such cells.

Large quantities of the nucleic acids and proteins of the present invention may be prepared by expressing the LRP5 or HBM nucleic acids or portions thereof in vectors or other expression vehicles in compatible prokaryotic or eukaryotic host cells. The most commonly used prokaryotic hosts are strains of *Escherichia coli*, although other prokaryotes, such as *Bacillus subtilis* or *Pseudomonas* may also be used.

Mammalian or other eukaryotic host cells, such as those of yeast, filamentous fungi, plant, insect, or amphibian or avian species, may also be useful for production of the proteins of the present invention. Propagation of mammalian cells in culture is per se well known. See, Jakoby and Pastan (eds.), *Cell Culture. Methods in Enzymology*, volume 58, Academic Press, Inc., Harcourt Brace Jovanovich, N.Y., (1979)). Examples of commonly used mammalian host cell lines are VERO and HeLa cells, Chinese hamster ovary (CHO) cells, and WI38, BHK, and COS cell lines, although it will be appreciated by the skilled practitioner that other cell lines may be appropriate, e.g., to provide higher expression desirable glycosylation patterns, or other features.

Clones are selected by using markers depending on the mode of the vector construction. The marker may be on the same or a different DNA molecule, preferably the same DNA molecule. In prokaryotic hosts, the transformant may be selected, e.g., by resistance to ampicillin, tetracycline or other antibiotics. Production of a particular product based on temperature sensitivity may also serve as an appropriate marker.

Prokaryotic or eukaryotic cells transformed with the nucleic acids of the present invention will be useful not only for the production of the nucleic acids and proteins of the present invention, but also, for example, in studying the characteristics of LRP5 or HBM proteins.

Antisense nucleic acid sequences are useful in preventing or diminishing the expression of LRP5 or HBM, as will be appreciated by one skilled in the art. For example, nucleic acid vectors containing all or a portion of the LRP5 or HBM gene or other sequences from the LRP5 or HBM region may be placed under the control of a promoter in an antisense orientation and introduced into a cell. Expression of such an antisense construct within a cell will interfere with LRP5 or HBM transcription and/or translation and/or replication. Also contemplated are RNA interference methodologies including siRNAs or shRNAs.

The probes and primers based on the LRP5 and HBM gene sequences disclosed herein are used to identify homologous LRP5 and HBM gene sequences and proteins in other species. These LRP5 and HBM gene sequences and proteins are used in the diagnostic/prognostic, therapeutic and drug screening methods described herein for the species from which they have been isolated.

XIX. Protein Expression and Purification

Expression and purification of the HBM protein of the invention can be performed essentially as outlined below. To facilitate the cloning, expression and purification of membrane and secreted protein from the HBM gene, a gene expression system, such as the pET System (Novagen), for cloning and expression of recombinant proteins in *E. coli* was selected. Also, a DNA sequence encoding a peptide tag, the His-Tap, was fused to the 3' end of DNA sequences of interest to facilitate purification of the recombinant protein products. The 3' end was selected for fusion to avoid alteration of any 5' terminal signal sequence.

Nucleic acids chosen, for example, from the nucleic acids set forth in SEQ ID NOS: 1, 3 and 5-12 for cloning HBM were prepared by polymerase chain reaction (PCR). Synthetic oligonucleotide primers specific for the 5' and 3' ends of the HBM nucleotide sequence were designed and purchased from Life Technologies (Gaithersburg, Md.). All forward primers (specific for the 5' end of the sequence) were designed to include an NcoI cloning site at the 5' terminus. These primers were designed to permit initiation of protein translation at the methionine residue encoded within the NcoI site followed by a valine residue and the protein encoded by the HBM DNA sequence. All reverse primers (specific for the 3' end of the sequence) included an EcoRI site at the 5' terminus to permit cloning of the HBM sequence into the reading frame of the pET-28b. The pET-28b vector provided a sequence encoding an additional 20 carboxyl-terminal amino acids including six histidine residues (at the C-terminus), which comprised the histidine affinity tag.

Genomic DNA prepared from the HBM gene was used as the source of template DNA for PCR amplification (Ausubel et al., *Current Protocols in Molecular Biology*, John Wiley & Sons (1994)). To amplify a DNA sequence containing the HBM nucleotide sequence, genomic DNA (50 ng) was introduced into a reaction vial containing 2 mM $MgCl_2$, 1 µM synthetic oligonucleotide primers (forward and reverse primers) complementary to and flanking a defined HBM, 0.2 mM of each of deoxynucleotide triphosphate, dATP, dGTP, dCTP, dTTP and 2.5 units of heat stable DNA polymerase (Amplitaq, Roche Molecular Systems, Inc., Branchburg, N.J.) in a final volume of 100 microliters.

Upon completion of thermal cycling reactions, each sample of amplified DNA was purified using the Qiaquick Spin PCR purification kit (Qiagen, Gaithersburg, Md.). All amplified DNA samples were subjected to digestion with the restriction endonucleases, e.g., NcoI and EcoRI (New England BioLabs, Beverly, Mass.) (Ausubel et al., *Current Protocols in Molecular Biology*, John Wiley & Sons, Inc. (1994)). DNA samples were then subjected to electrophoresis on 1.0% NuSeive (FMC BioProducts, Rockland, Me.) agarose gels. DNA was visualized by exposure to ethidium bromide and long wave UV irradiation. DNA contained in slices isolated from the agarose gel was purified using the Bio 101 GeneClean Kit protocol (Bio 101, Vista, Calif.).

The pET-28b vector was prepared for cloning by digestion with restriction endonucleases, e.g., NcoI and EcoRI (New England BioLabs, Beverly, Mass.) (Ausubel et al., *Current Protocols in Molecular Biology*, John Wiley & Sons, Inc. (1994)). The pET-28a vector, which encodes the histidine affinity tag that can be fused to the 5' end of an inserted gene, was prepared by digestion with appropriate restriction endonucleases.

Following digestion, DNA inserts were cloned (Ausubel et al., *Current Protocols in Molecular Biology*, John Wiley & Sons, Inc. (1994)) into the previously digested pET-28b expression vector. Products of the ligation reaction were then used to transform the BL21 strain of *E. coli* (Ausubel et al., *Current Protocols in Molecular Biology*, John Wiley & Sons, Inc. (1994)) as described below.

Competent bacteria, *E. coli* strain BL21 or *E. coli* strain BL21 (DE3), were transformed with recombinant pET expression plasmids carrying the cloned HBM sequence according to standard methods (Ausubel et al., *Current Protocols in Molecular Biology*, John Wiley & Sons, Inc. (1994)). Briefly, 1 µl of ligation reaction was mixed with 50 µl of electrocompetent cells and subjected to a high voltage pulse, after which samples were incubated in 0.45 ml SOC medium (0.5% yeast extract, 2.0% tryptone, 10 mM NaCl, 2.5 mM KCl, 10 mM $MgCl_2$, 10 mM $MgSO_4$ and 20 mM glucose) at 37° C. with shaking for 1 hour. Samples were then spread on LB agar plates containing 25 µg/ml kanamycin sulfate for growth overnight. Transformed colonies of BL21 were then picked and analyzed to evaluate cloned inserts, as described below.

Individual BL21 clones transformed with recombinant pET-28b HBM nucleotide sequences were analyzed by PCR amplification of the cloned inserts using the same forward and reverse primers specific for the HBM sequences that were used in the original PCR amplification cloning reactions. Successful amplification verifies the integration of the HBM sequence in the expression vector (Ausubel et al., *Current Protocols in Molecular Biology*, John Wiley & Sons, Inc. (1994)).

Individual clones of recombinant pET-28b vectors carrying properly cloned HBM nucleotide sequences were picked and incubated in 5 ml of LB broth plus 25 µg/ml kanamycin sulfate overnight. The following day plasmid DNA was isolated and purified using the Qiagen plasmid purification protocol (Qiagen Inc., Chatsworth, Calif.).

The pET vector can be propagated in any *E. coli* K-12 strain, e.g., HMS174, HB101, JM109, DH5 and the like, for purposes of cloning or plasmid preparation. Hosts for expression include *E. coli* strains containing a chromosomal copy of the gene for T7 RNA polymerase. These hosts were lysogens of bacteriophage DE3, a lambda derivative that carries the lacI gene, the lacUV5 promoter and the gene for T7 RNA polymerase. T7 RNA polymerase was induced by addition of isopropyl-β-D-thiogalactoside (IPTG), and the T7 RNA polymerase transcribes any target plasmid containing a functional T7 promoter, such as pET-28b, carrying its gene of interest. Strains include, for example, BL21(DE3) (Studier et al., *Meth. Enzymol.*, 185:60-89 (1990)).

To express the recombinant HBM sequence, 50 ng of plasmid DNA are isolated as described above to transform competent BL21(DE3) bacteria as described above (provided by Novagen as part of the pET expression kit). The lacZ gene (β-galactosidase) is expressed in the pET-System as described for the HBM recombinant constructions. Transformed cells were cultured in SOC medium for 1 hour, and the culture was then plated on LB plates containing 25 µg/ml kanamycin sulfate. The following day, the bacterial colonies were pooled and grown in LB medium containing kanamycin sulfate (25 µg/ml) to an optical density at 600 nM of 0.5 to 1.0 O.D. units, at which point 1 mM IPTG was added to the culture for 3 hours to induce gene expression of the HBM recombinant DNA constructions.

After induction of gene expression with IPTG, bacteria were collected by centrifugation in a Sorvall RC-3B centrifuge at 3500×g for 15 minutes at 4° C. Pellets were resuspended in 50 ml of cold mM Tris-HCl, pH 8.0, 0.1 M NaCl and 0.1 mM EDTA (STE buffer). Cells were then centrifuged at 2000×g for 20 minutes at 4° C. Wet pellets were weighed and frozen at −80° C. until ready for protein purification.

Chinese Hamster Ovary (CHO) Expression System

Alternatively, HBM and LRP5 may be expressed in eukaryotic cells. Eukaryotic cells, such as mammalian derived cell lines, are more capable of expressing properly folded proteins containing cystine rich domains such as the EGF and LDLR modules.

Development of Constructs

HBM and LRP5 extracellular domain fusions (ECD) to IgG-Fc were prepared. These ECD fusions to the IgG-Fc domain remove the endogenous transmembrane and cytoplasmic portion of the LRP5/HBM receptor and should produce a secreted fusion protein. The Fc region is separated from the LRP5/HBM ECD by an enterokinase recognition site so that purified LRP5 or HBM ECD protein can be obtained without the Fc domain present. The vector used for this construct was pHTop, a derivative of pED (Kaufman et al., 1991 *Nuc. Acids Res.* 19: 4485-4490) in which the majority of the adenomajor late promoter was replaced by six repeats of the tet operator (Gossen et al., 1992, *Proc. Natl. Acad. Sci. USA* 89:5547-5551). This vector contains the dihydrofolate reductase (dhfr) gene, and when introduced in the cell line CHO/A2 (see description below), functions very efficiently. Clones with high expression can be selected by isolating cells which survive in high methotrexate (MTX) concentrations.

The CHO expression vector pHTOP-Fc was digested with SalI and NotI. The intervening sequence was purified away from the rest of the vector by electroelution from an acrylamide gel slice. SalI cuts 5' to the intrinsic honey bee mellitin signal sequence in pHTOP-Fc, and NotI cuts just 5' to the coding sequence IgG1-Fc. The resulting SalI-NotI pHTOP-Fc vector has the signal sequence removed and the NotI cloning site is amenable to creating a 5' fusion to IgG-Fc. Full-length LRP5 in pCMVSPORT6 and full-length HBM in pCMVSPORT6 were digested individually with XmaI which cuts within the region of the ORF that encodes the signal sequence) and BamHI (that cuts internally in the ORF) to generate a 2286 bp 5' fragment of LRP5 and HBM. The mutation which distinguishes LRP5 from HBM lies on this fragment. Separately, the LRP5 DNA was digested with BamHI and SacI to isolate an 1800 bp 3' fragment which is common to both the LRP5 and the HBM genes. Together, these two fragments constitute the coding sequence for the HBM and LRP5 extracellular domains, less the coding sequence for the first 6 amino acids of the signal sequence and ending 18 amino acids prior to the end of the extracellular domain, which we estimated from Kyte-Doolittle plots to end at the sequence (SEQ ID NO:698) "SPAHSS."

A synthetic duplex was designed to recreate the coding sequence of the LRP5/HBM signal sequence 5' of the native XmaI site, which included the initiator methionine and Kozak sequence. This duplex was designed to contain SalI (5') and XmaI (3') cohesive ends to adapt ends to adapt the gene fragments described above to the pHTOP-Fc vector. This synthetic duplex was constructed from two partially complementary oligonucleotides as given below (SEQ ID NO:699-700):

```
5'-TCGACCACCATGGAGGCAGCGCCGC-3'

3'-GGTGGTACCTCCGTCGCGGCGGGCC-5'
```

A second synthetic duplex was designed to recreate the 3' coding sequence from a native SacI site to the estimated end of the extracellular domain following the serine in the sequence "... SPAHSS", and to also encode a cloning site to allow in-frame fusion to the downstream IgG-Fc. This duplex was designed to contain SacI (5') and NotI (3') cohesive ends to adapt the gene fragments described above to the pHTOP-Fc vector. This synthetic duplex was constructed from two partially complementary oligonucleotides whose sequences are given below (SEQ ID NO:701-702):

```
5'-CATGTGTGAAATCACCAAGCCGCCCTCAGACG
ACAGCCCGGCCCACAGCAGTGGC-3'

3'-TCGAGTACACACTTTAGTGGTTCGGCGGGAGT
CTGCTGTCGGGCCGGGTGTCGTCACCGCCGG-5'
```

The fragments, synthetic duplexes, and vector were ligated together in a single reaction. Separate reactions were performed for LRP5 and HBM. The ligation mixtures were used to transform electrocompetent E. coli DH10B cells, and the resulting colonies were screened by radioactive colony hybridization using the common SacI-BamHI 3' fragment as a probe. Colonies containing plasmids with the LRP5 or HBM fragment inserted were identified, and plasmids were isolated from multiple candidates and their sequences were verified by DNA sequencing. Verified constructs were then used for transfection into CHO cells.

Establishment of CHO Stable Cell Lines

The CHO/A2 cell line is derived from CHO DUKX B11 (Urlaub and Chasin, 1980, Proc. Natl. Acad. Sci. USA 77: 4216-4220) by stably integrating a transcriptional activator (tTA), a fusion protein, between the Tet repressor and the herpes virus VP16 transcriptional domain (Gossen et al.) CHO cell lines expressing extracellular HBM-1.Fc and LRP5.Fc were established by transfecting (using lipofection) pHTopHBM-1.Fc into CHO/A2 cells and pHTopZmax1.Fc into CHO/A2 cells. Clones were selected using by culturing the cells in 0.02 µM methotrexate. Clones were later amplified step-wise to a final concentration of 0.5 µM methotrexate.

Screening of CHO Stable Cell Lines

Multiple clones were screened by a variety of techniques. Clones were screened by Western blot assay using a (mouse) anti-human IgG.Fc horseradish peroxidase (HRP) antibody. The same clones were also metabolically labeled with $^{35}$S-Met/Cys) for a 6 hour pulse, or a 15 minute pulse, followed by a 1 hour, 4 hour, or 24 hour chase in media without radiolabeled Met/Cys. Immunoprecipitations were performed on proteins obtained from conditioned media, as well as from cell extracts. Purification is then performed followed by sequencing of the proteins using N-terminal sequencing as known in the art.

Fusion Protein Purification

LRP5-IgG or HBM-IgG fusion protein can be purified from conditioned media or cell extracts of CHO stable cells. The fusion protein is isolated by affinity binding to protein A (for example using protein A coated beads or columns). The IgG-FC domain can then subsequently be cleaved from the Zmax/HBM1 ECD protein by enterokinase digestion.

Potential Uses for Cell Lines and Protein

Stable cell lines may be used for generation of purified protein for use in ligand hunting, antibody generation, determination of crystal structure, and competitive binding assays.

A variety of methodologies known in the art can be used to purify the isolated proteins (Coligan et al., Current Protocols in Protein Science, John Wiley & Sons (1995)). For example, the frozen cells can be thawed, resuspended in buffer and ruptured by several passages through a small volume microfluidizer (Model M-110S, Microfluidics International Corp., Newton, Mass.). The resultant homogenate is centrifuged to yield a clear supernatant (crude extract) and, following filtration, the crude extract is fractioned over columns. Fractions are monitored by absorbance at $OD_{280}$ nm and peak fractions may be analyzed by SDS-PAGE.

The concentrations of purified protein preparations are quantified spectrophotometrically using absorbance coefficients calculated from amino acid content (Perkins, Eur. J. Biochem., 157:169-180 (1986)). Protein concentrations are also measured by the method of Bradford, Anal. Biochem., 72:248-254 (1976) and Lowry et al., J. Biol. Chem., 193:265-275 (1951) using bovine serum albumin as a standard.

SDS-polyacrylamide gels of various concentrations were purchased from BioRad (Hercules, Calif.), and stained with Coomassie blue. Molecular weight markers may include rabbit skeletal muscle myosin (200 kDa), E. coli β-galactosidase (116 kDa), rabbit muscle phosphorylase B (97.4 kDa), bovine serum albumin (66.2 kDa), ovalbumin (45 kDa), bovine carbonic anyhdrase (31 kDa), soybean trypsin inhibitor (21.5 kDa), egg white lysozyme (14.4 kDa) and bovine aprotinin (6.5 kDa).

Once a sufficient quantity of the desired protein has been obtained, it may be used for various purposes. A typical use is the production of antibodies specific for binding. These antibodies may be either polyclonal or monoclonal, and may be produced by in vitro or in vivo techniques well known in the art. Monoclonal antibodies to epitopes of any of the peptides identified and isolated as described can be prepared from murine hybridomas (Kohler, Nature, 256:495 (1975)). In summary, a mouse is inoculated with a few micrograms of HBM protein over a period of two weeks. The mouse is then sacrificed. The cells that produce antibodies are then removed from the mouse's spleen. The spleen cells are then fused with polyethylene glycol with mouse myeloma cells. The successfully fused cells are diluted in a microtiter plate and growth of the culture is continued. The amount of antibody per well is measured by immunoassay methods such as ELISA (Engvall, *Meth. Enzymol.*, 70:419 (1980)). Clones producing antibody can be expanded and further propagated to produce HBM antibodies. Other suitable techniques involve in vitro exposure of lymphocytes to the antigenic polypeptides, or alternatively, to selection of libraries of antibodies in phage or similar vectors. See Huse et al., *Science*, 246:1275-1281 (1989). For additional information on antibody production see Davis et al., *Basic Methods in Molecular Biology*, Elsevier, N.Y., Section 21-2 (1989).

LRP5 and LRP6 Polyclonal Antibodies

Polyclonal Antibodies were developed to both human LRP5 (SEQ ID NO:3) and LRP6 (GenBank Accession No. AF074264). Peptides from the LRP5 amino acid sequence were selected as immunogens based on five goals. 1) Maximize differences between LRP5 and LRP6 amino acid sequences (71% amino acid identity). See FIG. 27. For sequence comparison, typically one sequence acts as a reference sequence, to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s), relative to the reference sequence, based on the designated program parameters. 2) Minimize potential cross reactivity with other known genes by performing sequence alignment and similarity searches. Optimal alignment of sequences for comparison can be conducted, e.g., by the local homology algorithm of Smith and Waterman, *Adv. Appl. Math.* 2, 482 (1981), by the homology alignment algorithm of Needleman and Wunsch, *J. Mol. Biol.*, 48, 443 (1970), by the search for similarity method of Pearson and Lipman, *Proc. Natl. Acad. Sci. USA* 85, 2444 (1988), by computerized implementations of these algorithms and others in programs contained in the Wisconsin genetics software package, Genetics Computer Group, 585 Science Dr., Madison, Wis., or by visual inspection (see generally Ausubel et al., *Current Protocols in Molecular Biology*, John Wiley & Sons (1997). Another example of algorithm that is suitable for determining percent sequence identity and sequence similarity is the BLAST algorithm, which is described in Altschul et al., *J. Mol. Biol.* 215, 403-410 (1990). Software for performing BLAST analyses is publicly available through the National Center for Biotechnology Information. 3) Obtain peptides with the highest antigenicity index as possible as determined by PeptideStructure protein analysis using software programs contained in the Wisconsin Genetics software package, Genetics Computer Group, 575 Science Dr., Madison, Wis. 4) Locating peptides relative to highly homologous domains (e.g., EGF-like domains and LDL receptor repeats) within the gene family and the location relative to the extracellular and cytoplasmic regions of the gene. 5) And, for human LRP5 specific antibodies, the human amino acid sequence (SEQ ID NO:3) was compared to the mouse LRP5 sequence (GenBank Accession No. AF064984) and peptides were selected based on the above criteria in addition to minimizing the sequence similarity between the two species (See FIG. 26).

Using the same criteria above, LRP6 specific peptides were selected for polyclonal antibody production. The table lists the amino acid sequences that were chosen, the amino acid differences within the peptide between the human and mouse sequences. All the peptide sequences (ranging from 12-18 amino acids) were provided to Sigma/Genosys (St. Louis, Mo.) for peptide synthesis and subsequent polyclonal antibody production in New Zealand White Rabbits. The IgG fraction from the serum of each immunized rabbit was isolated using Protein G Sepharose (Amersham). Polyclonal antibody generation using these peptides may be done in other species as well, for example, chickens. This is often advantageous when there is a high degree of similarity between the human (reference) and murine/rodent sequence.

| Amino Acids | Amino Acids | H/M* Differences | Comments | SEQ ID NO: |
|---|---|---|---|---|
| 171-187 | VETPRIERAGMDGSTRK | 5 | Contains HBM polymorphism | 703 |
| 264-278 | NKRTGGKRKEILSAL | 3 | Extracellular | 704 |
| 290-301 | ERQPFFHTRCEE | 2 | Adjacent to EGF-I, extracellular | 705 |
| 532-546 | VDGTKRRTLLEDKLP | 5 | Extracellular | 706 |
| 901-915 | DGLNDCMHNNGQCGQ | 2 | In EGF-III, extracellular | 707 |
| 1010-1021 | PFVLTSLSQGQN | 6 | Extracellular, human specific | 708 |
| 1415-1429 | YAGANGPFPHEYVSG | 3 | Cytoplasmic | 709 |
| 1452-1464 | ACGKSMMSSVSLM | 5 | Cytoplasmic, human specific | 710 |
| 1556-1573 | RWKASKYYLDLNSDSDPY | 1 | Cytoplasmic | 711 |
| 888-902 | SGWNECASSNGHCSH | | LRP6 specific | 712 |
| 1308-1321 | NGDANCQDKSDEKN | | LRP6 specific | 713 |

*H/M-differences between human and mouse sequences

Single Chain Fv Molecules Developed by Phage Display

Peptides were chosen from the LRP5 sequence (SEQ ID NO:3) to screen for single chain Fv molecules by phage display. A total of 17 peptides from the LRP5 sequence were selected for synthesis and subsequent phage display screen for scFv molecules. All peptide synthesis and phage display work was performed at Cambridge Antibody Technology (CaT) in Cambridge, UK. Peptides were selected based on criteria as described above.

| Protein Domain | LRP5 Residues | LRP6 Residues | % Identity |
|---|---|---|---|
| Spacer 1 (+G171V) | 161-181 | 148-168 | 76% |
| Spacer 1 (−G171V) | 161-181 | 148-168 | 76% |
| EGF 1 | 301-321 | 288-308 | 76% |
| Spacer 2 | 401-421 | 388-408 | 52% |
| EGF 2 | 611-631 | 598-618 | 62% |
| Spacer 3 | 781-801 | 768-788 | 62% |
| EGF 3 | 921-941 | 908-928 | 10% |
| Spacer 4 | 1000-1021 | 988-1008 | 26% |
| EGF 4 | 1229-1249 | 1219-1239 | 76% |
| LDLR 1 | 1261-1282 | 1252-1272 | 81% |
| LDLR 2 | 1300-1320 | 1290-1310 | 57% |
| LDLR 3 | 1338-1358 | 1328-1348 | 48% |
| Cytosolic 1 | 1418-1438 | 1405-1425 | 14% |
| Cytosolic 1 | 1516-1536 | 1503-1525 | 52% |
| Cytosolic 1 | 1535-1555 | 1524-1544 | 81% |
| Cytosolic 1 | 1595-1615 | 1592-1613 | 82% |
| Spacer 2 (cross reactive) | 421-441 | 408-428 | 100% |

Note that a number of these regions (e.g. 401-421, 421-441, 781-801, and 1229-1249) share 100% identity with mouse LRP5 (see FIG. 26). Therefore, these may be used against both mouse and human forms of the protein. The peptide 421-441 was included to facilitate the generation of an antibody that would recognize both LRP5 and LRP6 (see FIG. 27). Two peptides were synthesized spanning the HBM mutation site (LRP5 residues 161-181), one with the LRP5 sequence and the other containing the HBM sequence.

Once scFv molecules were isolated, they were used as reagents in immunochemistry to detect LRP5 protein expression in a variety of human normal and diseased tissues. The details of the scFV antibody immunohistochemical analysis of three phage clones against peptide 1000-1021 (IKRAKDDGTQPFVLTSLSQGQN) (SEQ ID NO:714) of the extracellular domain of LRP5 showed positive staining with cardiac muscle, kidney, lung and liver. Expression was also detected in prostate carcinoma. These results are consistent with mRNA tissue distribution profiles as well as with the published reports of LRP5 mRNA localization (Kim et al., J. Biochem. 124: 1072-6, 1998). The resulting phage clones arise from pools and will be sequenced to identify potential variants in the Fv region of the molecules. Once identified, the suitable scFVs can then be subcloned into variable heavy chain and variable light chain DNA constructs for cotransfection into COS cells for final assembly of an intact and functional immunoglobulin gamma (IgG) molecule. The IgG that is expressed by the cells can then be further characterized for specificity and reactivity as would be known in the art.

Monoclonal Antibody Development

Monoclonal antibodies can be developed to LRP5 and HBM, as well as variants thereof, by complete cell and adenovirus immunization of, for example, Balb/c mice. Dendritic cells can be isolated from spleens of Balb/c mice, for example, and the cells expanded in vitro in the presence of growth factors IL-4 and GM-CSF. The dendritic cells can then be infected with HBM or LRP5 adenovirus particles. The cells are then cultured for 24 hours prior to intravenous injection into Balb/c mice. Dentritic cells ($1 \times 10^6$ cells/mouse) are injected 2-3 times every 3-4 weeks over a three month period.

Alternatively, purified HBM and LRP5 DNAs in, for example, the pcDNA3.1 expression vector, can be coated on colloidal gold particles. These particles can then be injected subcutaneously into the desired mouse using gene gun technology. Approximately, 5 μg cDNA/mouse can be injected. Injections are performed 4-6 times every 2 weeks over approximately a 3 month period.

Another option is that cells (any species of animal, but preferably Balb/c mouse strain or the same species as the mouse strain being used which is related to limit antigen response to non-specific protein) overexpressing HBM and LRP5 and their respective adenovirus will be injected into the mice every 2-3 weeks for a period of about 1.5 to 3 months, as necessary. The bleeds from the mice can be tested for reactivity with the native and denatured protein by ELISA (using purified protein or protein-fusions), cell based ELISA, immunohistochemical staining and Western blotting. Serum samples from the animals can be screened by FACS (fluorescent activated cell sorting) using cells infected with LRP5 or HBM adenovirus. The spleen cells (antibody producing cells) from the mice with the strongest reactivity can then be fused with a myeloma to generate the hybridoma cells. The conditioned media from the hybridoma is then screened for the positive cell colonies for subsequent cloning. These cloned cells can then be injected into the intraperitoneal space in mice for ascites production.

Polyclonal Antibody Applications

Polyclonal antibodies directed against LRP5 and LRP6 were developed to determine the function of these proteins, analyze the expressed pattern and levels in various tissues, cells or any biological sample. Uses for polyclonal antibodies against LRP5, HBM, LRP6 and related variants include, but are not limited to: analysis of bone cross-sectional mounts, tissue distribution, evaluation of expression of the protein from bone biopsy samples of affected/non-affected family members (e.g., bone cell digests, explants of bone marrow stromal cell cultures), evaluation of protein expression levels in transiently or stably transfected cells, evaluating protein concentration in tissues, serum or body fluid, purification of full length or fragments of these proteins for ligand hunting and functional assay development, identification of ligands or proteins which interact with these proteins, and elucidations of the signaling pathways of LRP6, LRP5 and HBM, and related variants.

For example, LRP5 cloned in pcDNA3.1 (Invitrogen, Carlsbad, Calif.). This was used to generate $^{35}$S-labeled in vitro translated (Promega, Madison, Wis.) LRP5. Antibody (10 μg/ml) 3109 and 3110, which are directed against peptide immunogen RWKASKYYLDLNSDSDPY (SEQ ID NO:711), was combined with 20 μl of the in vitro translated product in the presence of either 10 μg/ml specific peptide (i.e., RWKASKYYLDLNSDSDPY)(SEQ ID NO:711) or non-specific peptide (i.e., SGWNECASSNGHCSH)(SEQ ID NO:712) or no peptide and incubated for 1.5 hr at 4° C. Protein A Sepharose was then added to the samples (previously blocked for about 1.5 hr with reticulocyte lysate), and the samples were shaken for 1 hour at 4° C. The protein A Sepharose was washed 3 times with 0.5 ml of PBS. The bound protein was subsequently separated on a 4-12% gradient NuPAGE gel (Invitrogen) according to manufacturer's instructions. The gel was dried at 80° C. for 30 min and then exposed to Kodak X-OMAT-AR film for 24 to 48 hr. The specific peptide was observed to significantly compete for the $^{35}$S-labeled LRP5 immunoprecipitated protein with either antibody. The competition was not observed with a non-specific peptide.

These antibodies can also be used for immunohistochemistry. For example, HBM transgenic and wild-type mice were sacrificed using $CO_2$ narcosis. Mouse calvariae were removed intact, and the soft tissues gently dissected. The bones were fixed in 10% phosphate buffered formalin for 24 hours for further processing and analysis. After fixation, calvariae were decalcified in TBD-2 decalcifying agent (Shandon, Pittsburgh, Pa.) for about 7-8 hours and then dehydrated in graded alcohol. Calvariae were then bisected perpendicular to the sagittal suture through the central portion of the parietal bones parallel to the lambdoidal and coronal sutures and embedded in paraffin. Four to six 5 µm thick representative sections were cut.

For example, the rabbit polyclonal antibody, LRP5/HBM (i.e., antibody 3109 and 3110) recognize LRP5 in both HBM transgenic and wild-type mouse calvariae. An anti-LRP5 or anti-HBM antibody can be used to detect LRP5 or HBM protein in order to evaluate its abundance and pattern of protein expression. Detection can be facilitated by coupling (i.e., physically linking) the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, P-galactosidase, or acetylcholinesterase; example of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; and example of a luminescent material includes luminol; examples of bioluminescent materials include luciferase, luciferin and acquorien; and examples of suitable radioactive material include $^{125}$I, $^{131}$I, $^{35}$S, and $^{3}$H. Alternatively, a secondary antibody can be employed that detects the presence of the primary LRP5 polyclonal antibody. An example would be an antibody that recognized all rabbit immunoglobulins. This secondary antibody could be coupled in an identical manner as described above to facilitate detection. Controls comprised samples with the avidin peroxidase, but without antibody. Intensive positive staining of stroma cells and mesenchymal cells was observed in the suture area. Pre-osteoblasts and osteoblasts were observed to stain within the periosteum and some osteocytes with antibody 3109 and 3110 in the calvariae of the HBM compared to wild-type mice. High magnification of tissue calvaria sections of the HBM transgenic mice showed a pronounced cell membrane staining of the osteocytes and the cells within the suture area.

XX. Methods of Use: Gene Therapy

In recent years, significant technological advances have been made in the area of gene therapy for both genetic and acquired diseases. (Kay et al., Proc. Natl. Acad. Sci. USA, 94:12744-12746 (1997)) Gene therapy can be characterized as the deliberate transfer of DNA for therapeutic purposes. Improvement in gene transfer methods has allowed for development of gene therapy protocols for the treatment of diverse types of diseases. Gene therapy has also taken advantage of recent advances in the identification of new therapeutic genes, improvement in both viral and nonviral gene delivery systems, better understanding of gene regulation, and improvement in cell isolation and transplantation.

The preceding experiments identify the HBM gene as a dominant mutation conferring elevated bone mass. The fact that this mutation is dominant indicates that expression of the HBM protein causes elevated bone mass. Older individuals carrying the HBM gene, and, therefore expressing the HBM protein, do not suffer from osteoporosis. These individuals are equivalent to individuals being treated with the HBM protein. These observations are a strong experimental indication that therapeutic treatment with the HBM protein prevents osteoporosis. The bone mass elevating activity of the HBM gene is termed "HBM function."

Therefore, according to the present invention, a method is also provided of supplying HBM function to mesenchymal stem cells (Onyia et al., J. Bone Miner. Res., 13:20-30 (1998); Ko et al., Cancer Res., 56:4614-4619 (1996)). Supplying such a function provides protection against osteoporosis. The HBM gene or a part of the gene may be introduced into the cell in a vector such that the gene remains extrachromosomal. In such a situation, the gene will be expressed by the cell from the extrachromosomal location.

Vectors for introduction of genes both for recombination and for extrachromosomal maintenance are known in the art, and any suitable vector may be used. Methods for introducing DNA into cells such as electroporation, calcium phosphate co-precipitation, and viral transduction are known in the art, and the choice of method is within the competence of one skilled in the art (Robbins, Ed., Gene Therapy Protocols, Human Press, NJ (1997)). Cells transformed with the HBM gene can be used as model systems to study osteoporosis and drug treatments that promote bone growth.

As generally discussed above, the HBM gene or fragment, where applicable, may be used in gene therapy methods in order to increase the amount of the expression products of such genes in mesenchymal stem cells. It may be useful also to increase the level of expression of a given HBM protein, or a fragment thereof, even in those cells in which the wild type gene is expressed normally. Gene therapy would be carried out according to generally accepted methods as described by, for example, Friedman, Therapy for Genetic Diseases, Friedman, Ed., Oxford University Press, pages 105-121 (1991).

A virus or plasmid vector containing a copy of the HBM gene linked to expression control elements and capable of replicating inside mesenchymal stem cells, is prepared. Suitable vectors are known and described, for example, in U.S. Pat. No. 5,252,479 and WO 93/07282, the disclosures of which are incorporated by reference herein in their entirety. The vector is then injected into the patient, either locally into the bone marrow or systemically (in order to reach any mesenchymal stem cells located at other sites, i.e., in the blood). If the transfected gene is not permanently incorporated into the genome of each of the targeted cells, the treatment may have to be repeated periodically.

Gene transfer systems known in the art may be useful in the practice of the gene therapy methods of the present invention. These include viral and non-viral transfer methods. A number of viruses have been used as gene transfer vectors, including polyoma, i.e., SV40 (Madzak et al., J. Gen. Virol., 73:1533-1536 (1992)), adenovirus (Berkner, Curr. Top. Microbiol. Immunol., 158:39-61 (1992); Berkner et al., Bio Techniques, 6:616-629 (1988); Gorziglia et al., J. Virol., 66:4407-4412 (1992); Quantin et al., Proc. Natl. Acad. Sci. USA, 89:2581-2584 (1992); Rosenfeld et al., Cell, 68:143-155 (1992); Wilkinson et al., Nucl. Acids Res., 20:2233-2239 (1992); Stratford-Perricaudet et al., Hum. Gene Ther., 1:241-256 (1990)), vaccinia virus (Mackett et al., Biotechnology, 24:495499 (1992)), adeno-associated virus (Muzyczka, Curr. Top. Microbiol. Immunol., 158:91-123 (1992); Ohi et al., Gene, 89:279-282 (1990)), herpes viruses including HSV and EBV (Margolskee, Curr. Top. Microbiol. Immunol., 158:67-90 (1992); Johnson et al., J. Virol., 66:2952-2965 (1992); Fink et al., Hum. Gene Ther., 3:11-19 (1992); Breakfield et al., Mol. Neurobiol., 1:337-371 (1987;) Fresse et al., Biochem. Pharmacol., 40:2189-2199 (1990)), and retroviruses of avian (Brandyopadhyay et al., Mol. Cell Biol., 4:749-754 (1984); Petropouplos et al., J. Virol., 66:3391-3397 (1992)), murine (Miller, Curr. Top. Microbiol. Immunol., 158:1-24 (1992); Miller et al., Mol. Cell Biol., 5:431-437 (1985); Sorge et al., Mol. Cell Biol., 4:1730-1737 (1984); Mann et al., J. Virol., 54:401-407 (1985)), and human origin (Page et al., J. Virol., 64:5370-5276 (1990); Buchschalcher et al., J. Virol., 66:2731-2739 (1992)). Most human gene therapy protocols have been based on disabled murine retroviruses.

Non-viral gene transfer methods known in the art include chemical techniques such as calcium phosphate coprecipitation (Graham et al., Virology, 52:456-467 (1973); Pellicer et al., Science, 209:1414-1422 (1980)), mechanical techniques, for example microinjection (Anderson et al., Proc. Natl. Acad. Sci. USA, 77:5399-5403 (1980); Gordon et al., Proc. Natl. Acad. Sci. USA, 77:7380-7384 (1980); Brinster et al., Cell, 27:223-231 (1981); Constantini et al., Nature, 294:92-94 (1981)), membrane fusion-mediated transfer via liposomes (Felgner et al., Proc. Natl. Acad. Sci. USA, 84:7413-7417 (1987); Wang et al., Biochemistry, 28:9508-9514 (1989); Kaneda et al., J. Biol. Chem., 264:12126-12129 (1989); Stewart et al., Hum. Gene Ther., 3:267-275 (1992); Nabel et al., Science, 249:1285-1288 (1990); Lim et al., Circulation, 83:2007-2011 (1992)), and direct DNA uptake and receptor-mediated DNA transfer (Wolff et al., Science, 247:1465-1468 (1990); Wu et al., BioTechniques, 11:474-485 (1991); Zenke et al., Proc. Natl. Acad. Sci. USA, 87:3655-3659 (1990); Wu et al., J. Biol. Chem., 264:16985-16987 (1989); Wolff et al., BioTechniques, 11:474-485 (1991); Wagner et al., 1990; Wagner et al., Proc. Natl. Acad. Sci. USA, 88:4255-4259 (1991); Cotten et al., Proc. Natl. Acad. Sci. USA, 87:4033-4037 (1990); Curiel et al., Proc. Natl. Acad. Sci. USA, 88:8850-8854 (1991); Curiel et al., Hum. Gene Ther., 3:147-154 (1991)). Viral-mediated gene transfer can be combined with direct in vivo vectors to the mesenchymal stem cells and not into the surrounding cells (Romano et al., In Vivo, 12(1):59-67 (1998); Gonez et al., Hum. Mol. Genetics, 7(12):1913-9 (1998)). Alternatively, the retroviral vector producer cell line can be injected into the bone marrow (Culver et al., Science, 256:1550-1552 (1992)). Injection of producer cells would then provide a continuous source of vector particles. This technique has been approved for use in humans with inoperable brain tumors.

In an approach which combines biological and physical gene transfer methods, plasmid DNA of any size is combined with a polylysine-conjugated antibody specific to the adenovirus hexon protein, and the resulting complex is bound to an adenovirus vector. The trimolecular complex is then used to infect cells. The adenovirus vector permits efficient binding, internalization, and degradation of the endosome before the coupled DNA is damaged.

Liposome/DNA complexes have been shown to be capable of mediating direct in vivo gene transfer. While in standard liposome preparations the gene transfer process is non-specific, localized in vivo uptake and expression have been reported in tumor deposits, for example, following direct in situ administration (Nabel, Hum. Gene Ther., 3:399-410 (1992)).

XXI. Methods of Use: Transformed Hosts and Transgenic Animals as Research Tools and for the Development of Pharmaceuticals Cells and animals that carry the HBM, LRP5, or LRP6 gene, used as model systems, are valuable research tools to study and test for substances that have potential as therapeutic agents (Onyia et al., J. Bone Miner. Res., 13:20-30 (1998); Broder et al., Bone, 21:225-235 (1997)). Cells for this purpose are typically cultured mesenchymal stem cells. These may be isolated from individuals with somatic or germline HBM genes. Alternatively, the cell line can be engineered to carry the HBM gene, as described above. After a test substance is applied to the cells, the transformed phenotype of the cell is determined. Any trait of transformed cells can be assessed, including, for example, formation of bone matrix in culture (Broder et al., Bone, 21:225-235 (1997)), mechanical properties (Kizer et al., Proc. Natl. Acad. Sci. USA, 94:1013-1018 (1997)), expression of marker genes and response to application of putative therapeutic agents.

Transgenic modified animals and cell lines may be used to test therapeutic agents. Transgenic modifications include, for example, insertion of the LRP5 gene, as well as insertion of the HBM gene and disrupted homologous genes. Alternatively, the inserted LRP5 gene(s) and/or HBM gene(s) of the animals may be disrupted by insertion or deletion mutation of other genetic alterations using conventional techniques, such as those described by, for example, Capecchi, Science, 244:1288 (1989); Valancuis et al., Mol. Cell Biol., 11:1402 (1991); Hasty et al., Nature, 350:243 (1991); Shinkai et al., Cell, 68:855 (1992); Mombaerts et al., Cell, 68:869 (1992); Philpott et al., Science, 256:1448 (1992); Snouwaert et al., Science, 257:1083 (1992); Donehower et al., Nature, 356:215 (1992). After test substances have been administered to the animals, the growth of bone must be assessed. If the test substance modulates (e.g., enhances) the growth of bone, then the test substance is a candidate therapeutic agent. These animal models provide an extremely important vehicle for potential therapeutic products.

The present invention also provides animals and cell lines wherein the expression of endogenous genes are activated, and may be further amplified, which does not require in vitro manipulation and transfection of exogenous DNA encoding LRP5 or HBM proteins. These methods are described for example in PCT Application WO 94/12650 and U.S. Pat. No. 5,968,502, both of which are herein incorporated in their entirety by reference. In addition, the present invention includes methods wherein endogenous activation or overexpression is achieved by in situ homologous recombination, non-homologous recombination, or illegitimate recombination methods. These methods are described for example in PCT Applications WO 99/15659 and WO 00/49162, both of which are incorporated herein in their entirety.

Creating Transgenic and Gene-targeted Animals.

The present invention provides genetically modified animals that recapitulate the human HBM phenotype. The approaches taken involve the creation of both transgenic and gene-targeted animals that have the human G to T nucleotide substitution incorporated into the genome, animals which express human LRP5 (Zmax1) or express a variant which produces a bone mass altering phenotype. Subsequent to the making of the present invention, Kato et al., (Journal of Cell

*Biology*, 157:303-14, 2002) have recently described the creation of LRP5 knock-out mice which demonstrated a low bone mass phenotype. The results described by Kato and coworkers is consistent with the hypothesis that LRP5 is a determinant of peak bone mass and demonstrates aspects of the utility of the present invention.

Transgenic Mice Over-expressing the HBM Polymorphism.

Plasmid constructs were prepared that utilized either the CMVbActin or type I collagen promoters to drive expression of the human HBM cDNA. The most commonly-used promoters for mammalian expression are from cytomegalovirus (CMV), Rous sarcoma virus (RSV), Simian virus 40 (SV40), and EF-1a (human elongation factor 1a-subunit). CMV is derived from the human cytomegalovirus immediate-early viral promoter. CMV is a stronger promoter in most cell lines than either RSV or SV40. The RSV promoter is derived from an avian virus and tends to be a strong promoter in avian cell lines. The SV40 promoter expresses well in cell lines that carry the large T antigen, such as COS-1. In these cell lines, the plasmid is replicated to higher copy numbers. EF-1a is beginning to be more widely used for recombinant protein expression. EF-1a is the promoter from the human elongation factor 1a-subunit, a gene that is highly expressed and conserved in mammalian cell lines.

The chimeric CMVbActin promoter is a strong promoter that has been shown to produce ubiquitous gene expression in transgenic mice including bone. This promoter was chosen to drive expression of HBM in a manner consistent with the reported widespread expression of the endogenous mouse LRP5 gene. Although the HBM phenotype is observed in bone, the HBM gene may have direct or indirect effects in other tissues. Therefore, other strong ubiquitous promoters may be utilized as would be known to those skilled in the art.

Type I collagen promoters provide tissue-restricted gene expression wherein expression is primarily limited to bone. Other bone-specific promoters are available that could result in expression of HBM in bone. For example, promoters associated with proliferation of osteoblasts include histone, type I collagen, TGFβ1, MSX2, cfos/cJun and Cbfa1 may be used. Promoters associated with bone matrix maturation including alkaline phosphatase, MGP, Cbfa1, Fra/Jun and D1×5 also can be used. Promoters associated with bone mineralization such as osteocalcin, osteopontin, bone sialoprotein and collagenase also can be used. The promoter chosen would be determined by, for example, the tissue expression, the degree of regulatable control and the like as would be known to the skilled artisan. For example, the type I collagen promoters were chosen to insure that HBM would be expressed in bone in a temporal, spatial and bone cell-specific pattern resembling the endogenous pattern of LRP5 expression in bone.

Transgenic Mice Over-expressing the Wild-type LRP5 Gene.

Plasmid constructs were prepared using the CMVbActin and type I collagen promoters driving expression of LRP5. These animals can serve as a control animal model for the HBM transgenic mice. Additional controls include non-transgenic littermates and wild-type animals of an identical genetic background. Methods for preparing these animals would be similar to what is discussed for mice which over express the HBM polymorphism.

Gene-targeted Mice Expressing the HBM Polymorphism.

A gene-targeting construct was prepared that could be used to create animals containing a HBM knock-in (KI) allele and a LRP5 knock-out (KO) allele. The gene-targeting construct contained the HBM polymorphism in exon 3 and included a neomycin selection cassette that was linked to a transcriptional stop sequence and was flanked with lox P sites. The HBM polymorphism in mouse LRP5 results in a glycine to valine change in the amino acid sequence at position 170 of the mouse LRP5 homolog (Genbank Accession No. AF064984). Homologous recombination is used to stably introduce the construct into the mouse genome. If the transcriptional stop sequence functioned to completely block transcription of the modified LRP5 allele, then a functional LRP5 knock-out allele would be generated. This would facilitate production of a homozygous knock-out animal for the LRP5 gene.

To create the knock-in allele, Cre recombinase could be used to excise the neomycin selection cassette leaving behind the modified exon 3 and one copy of the loxP site. Cre could be introduced into single-cell fertilized embryos to facilitate ubiquitous expression of HBM or by crossing animals with transgenic mice to obtain bone-specific HBM expression. Homozygous animals could be made for the HBM knock-in allele. Alternatively, animals could be created by nuclear transfer techniques, wherein nuclei from homozygous animals is transferred into a prepared oocyte (e.g., enucleated) as is known in the art. See, e.g., Campbell et al., *Nature* 380: 64-68 (1996). Additional methods of creating knock out mice include engineering a homologous recombination vector wherein the ATG start codon is deleted or mutated, engineering a frame-shift mutation into the vector, engineering deletions of critical portions of the promoter region, and/or engineering a vector to delete critical regions of the gene.

Materials and Methods

Construction of the LRP5 Plasmid ZMAXGI_3AS

The full-length LRP5 cDNA construct has been engineered into the XbaI-NotI sites of the pCMVSPORT6.0 vector from Life Technologies (part of the Gateway cloning system) to create ZMAXGI_3AS. The insert (5,278 bp) can be released from the vector by digestion with either HindIII or XbaI on the 5' side together with either EcoRV or EcoRI on the 3' end.

The LRP5 construct was generated from four independent partial clones. These clones were isolated from a LRP5 specific primed cDNA library. A partial LRP5 cDNA clone existed in the internal survey sequencing clone set as L236B_P0049E08 isolated from an oligo-dT primed HeLa cell cDNA library. This clone was truncated at the 5-primed end. In order to isolate more 5-prime containing fragments necessary to generate a full length cDNA, a LRP5 gene-specific cDNA library was generated from Clontech human liver poly-A mRNA (catalog #6510-1, lot #9060032) and Life Technologies SuperScript® Plasmid System for cDNA Synthesis and Plasmid Cloning kit (catalog no. 18248-013). This library was designated as L401. The manufacturer's protocol was carried out with the following modifications. 1)In both first and second strand synthesis reactions, DEPC-treated water was substituted for $\alpha$-$^{32}$P-dCTP. 2)Reverse transcription was primed using oligonucleotides that were selected to be specific for the LRP5 gene at approximately 1 kb intervals. These sequences were checked using the program BLAST against the public databases to ensure LRP5 specificity. 3)Two separate reverse transcription reactions were performed. The first reaction, (A), was primed with oligonucleotides which annealed to the more 3' regions of LRP5 as follows (SEQ ID NO:715-718):

47114: 5'-CGTACGTAAAGCGGCCGCTTGGCAATA-CAGATGTGGGA-3',

47116:5'-CGTACGTAAAGCGGCCGCAGTAGCTC-CTCTCGGTGGC-3',

47118:5'-CGTACGTAAAGCGGCCGCGCTCATCATG-GACTTTCCG-3' and
47120:5'-CGTACGTAAAGCGGCCGCGCACTGCT-GTTTGATGAGG-3'. The second reaction, (B), used the previously mentioned four oligonucleotides, as well as (SEQ ID NO:719-721)
47108:5'-CGTACGTAAAGCGGCCGCGAGTGTGGAA-GAAAGGCTGC-3',
47110:5'-CGTACGTAAAGCGGCCGCAGTAGAGCT-TCCCCTCCTGC-3' and
47112:5'-CGTACGTAAAGCGGCCGCGTCCATCAC-GAAGTCCAGGT-3'. All oligonucleotides contained a NotI linker sequence and were used at a concentration of 0.02 ug/ul. 4)The SalI-adapted cDNA from both reverse transcription reactions was size-fractionated by electrophoresis on 1% agarose, 0.1 ug/ml ethidium bromide, 1×TAE gels. The ethidium bromide-stained cDNA between 0.6 and 8.0 kb was excised from the gel. The cDNA was purified from the agarose gel by electroelution (ISCO Little Blue Tank Electroelutor®) using the manufacturer's protocol. The purified cDNA from reactions A and B were then pooled together. 5) The size-fractionated SalI-adapted cDNA was ligated to NotI-SalI digested pBluescript® (Stratagene, La Jolla, Calif.).

Ligated library cDNA (3 µl) was used to transform electrocompetent E. coli cells (ElectroMAX® DH10B cells and protocol, Life Technologies catalog no. 18290-015, BioRad E. coli pulser, voltage 1.8KV, 3-5 msec pulse). The transformed cells were plated on LB-ampicillin (100 ug/ml) agar plates and incubated overnight at 37° C. Approximately $10^6$ colony forming units (cfu) were plated at a density of 50,000 cfu/150 mm plate. Cells were washed off the plates with LB media, and collected by centrifugation. Plasmid DNA was purified from the cells using the QIAGEN Plasmid Giga Kit and protocol (catalog no. 12191) at a final concentration of 2.05 µg/µl.

Two probes for use in library screening were generated by the polymerase chain reaction (PCR) using 100 ng of library L401 as template. Standard PCR techniques were used. A reaction mixture contained 10 pmol of each oligo primer; 0.2 mM each dATP, dTTP, dCTP and dGTP (PE Applied Biosystems catalog no. N808-0260); 1.5 units Expand™ High Fidelity Taq DNA polymerase and 1× PCR reaction buffer (Roche Molecular Biochemicals, catalog no. 732-641; 10 mM Tric-HCl, 1.5 mM $MgCl^2$, 50 mM KCl, pH 8.3). The mixture was incubated at 99° C. for one minute, followed by 30 cycles of 96° C. for 15 seconds, 50° C. for 30 seconds, 72° C. for 1 minute with a final incubation at 72° C. for 7 minutes (MJResearch DNA Engine® Tetrat PTC-225). The first was generated using oligos (SEQ ID NOS:722-723) 107335:5'-CAGCGGCCTGGAGGATGC-3' and 107338:5'-CGGTC-CAGTAGAGGTTTCG-3', which amplify a NotI-SalI fragment of the LRP5 gene. The second was generated using oligos (SEQ ID NOS:724-725) 107341:5'-CATCAGC-CGCGCCTTCATG-3' and 107342:5'-CCTGCATGTTGGT-GAAGTAC-3', which amplify a SacI-KpnI fragment of the LRP5 gene. Both PCR products were purified using the Qiaquick® kit and the manufacturer's protocol (Qiagen catalog 28106) then subcloned into the vector pCRII-TOPO® (Invitrogen catalog no. K4600) following the manufacturer's protocol. Positive subclones were identified by restriction digestion of purified plasmid DNA (using standard molecular biology techniques) and subsequent DNA sequence analysis (ABI Prism BigDye Terminator Cycle® sequencing, catalog no. 4303154, ABI 377 instruments). Probe DNA was isolated by EcoRI restriction digestion (New England Biolabs, catalog no. R0101L) of the respective sequence-verified pCRII-TOPO® clone. Restriction fragments were size-fractionated by gel electrophoresis on 1% agarose, 0.1 ug/ml ethidium bromide, 1×TAE gels. Insert DNA was excised from the gel and purified using the Clontech NucleoSpin® Nucleic Acid Purification Kit (catalog no. K3051-2) following the manufacturer's protocol. The purified DNA fragment (25-50 ng) was labeled with Redivue® ($a^{32}P$)-dCTP (Amersham Pharmacia, catalog no. AA0005) using the Prime-It II® Random Primer labeling Kit and protocol (Stratagene, catalog no. 300385). Unincorporated dCTP was removed with Amersham's NICK® column and protocol (catalog no. 17-0855-02).

Two rounds of screening library L401 were initiated to isolate fragments of the LRP5 gene. In the first, forty-three 150 cm LB –100 ug/ml ampicillin agar plates were plated with primary transformants from L401 at a density of about 3,000-4,000 colonies per plate. This library was screened using the $^{32}P$-labeled probe (NotI-SalI fragment) as described above at 500,000-1,000,000 cpm/ml hybridization buffer, using standard molecular biology protocols. From this primary screen, 13 single colonies were identified based on positive hybridization to the LRP5 probe. Plasmid DNA, prepared using the QIAprep Spin Miniprep Kit and protocol (Qiagen Inc., catalog no. 27106), was analyzed by restriction digestion and sequence analysis as described above. cDNA clone #44 was isolated from this screen and sequence verified to contain a partial LRP5 clone.

In the second library screen, one hundred-and-four 150 cm LB ampicillin 100 ug/ml agar plates were plated with primary transformants from L401 at a density of 3000-4000 colonies per plate. This library was screened using the $^{32}p$-labeled probe (SacI-KpnI) exactly as previously described. From this primary screen, 48 colonies were identified based on positive hybridization to the LRP5 probe. Since these colonies were not single colony isolates, a secondary screen was initiated where each of the 48 primary isolates was plated at a density of approximately 500 colonies per plate. These colonies were then screened exactly as the primaries using the labeled SacI-KpnI fragment as probe. Thirty-four of the 48 primary clones resulted in positive hybridization to the LRP5 probe and were isolated as single colonies. Plasmid DNA was prepared and analyzed as described above. cDNA isolate #71_2 was isolated from this screen and sequence verified to contain a partial LRP5 clone.

In all cases, the sequence of any LRP5 isolate was compared to a reference sequence (i.e., the sequence of the wild-type LRP5 allele from an affected member of the HBM kindred). This analysis was important since DNA polymorphisms had been reported for this gene in the literature. This reference sequence is predicted to encode a polypeptide of Genbank Accession No. AF077820.

The four independent partial clones used to prepare ZmaxIGI_3AS are as follows:
1) Bases 1-1366: A XbaI-SalI fragment was obtained from a LRP5 cDNA construct, GTC.Zmax1_13. GTC.Zmax1_13 contains a 5075 BP insert containing the entire ORF of LRP5. The clone was blunt end cloned in the EcoRV site of pSTBlue-1. This clone was generated by fusing a 5' clone derived from screening a bone random primed cDNA library in a pBluescript™ II derivative with a 3' clone derived from a PCR product from a bone dT primed cDNA library in pBluescript™ II. PCR was performed using LRP5 specific forward primer (SEQ ID NO:726) 5'-GC-CCGAAACCTCTACTGGACCGAC-3' and reverse primer (SEQ ID NO:727) 5'-GCCCACCCCATCACAGT-TCACATT-3' using DNAzyme polymerase. The resultant 3.7 kb PCR product was cloned into PCR-XL-TOPO. To generate the full length clone the 5' and 3' plasmids were transformed into DM1 (dam-) from Gibco/BRL. The 5' plasmid was digested with XbaI and the 3' plasmid was digested with HindIII. The digested plasmids were filled in with T4 polymerase to generate blunt ends and cut with BclI. the 1.7 kb 5' fragment and 3.5 kb 3' fragments were gel purified, ligated together, and cloned in the EcoRV site of pSTBlue-1. It provides a short 5' UTR, with coding sequence beginning at base 100. Furthermore, it carries some additional restriction sites at the 5' multiple cloning site. This fragment also contains a DNA polymorphism relative to the Genbank Accession No. AF077820 sequence at position 558 resulting in an A (AF077820) to a G change; this mutation does not result in an amino acid difference (Pro).

2) Bases 1367-2403: This clone was obtained from a LRP5-gene primed cDNA library made from commercial human liver RNA described above. This fragment is a SalI-BamHI piece of DNA obtained from isolate #44. The sequence is identical to Genbank Accession No. AF077820.

3) Bases 2404-4013: This BamHI-BssHII fragment was obtained from isolate #71-2 from the same library as described above. At position 3456, there is a DNA polymorphism resulting in a G (AF077820) to an A. This nucleotide difference does not change the encoded amino acid (Val).

4) Bases 4014-5278: This BssHII-NotI fragment came from an internal clone, L236B_P0049E08. It was obtained from an oligo-dT primed HeLa cell cDNA library. The stop codon occurs at base 4947. The clone contains 331 bp of 3' UTR sequence, including a 120 bp poly-A tail followed by the NotI site. The 3' NotI site used in this subcloning step is a result of an added linker that was introduced at the end of the poly-A tail during library construction. A DNA polymorphism is present at base 4515 resulting in a G (AF077820) to C change that is silent at the amino acid level (Leu).

To generate the 5' section of the LRP5 gene, the XbaI-SalI fragment and SalI-BamHI fragment were ligated into the XbaI-BamHI sites of pBluescript® (Stratagene). The 3' section of the gene was obtained by ligating the 1.61 kb BamHI-BssHII fragment from LRP5 isolate #71_2 to the 1.26 kb BssHII-NotI fragment from L236B_P0049E08. These two fragments were ligated into the BamHI-NotI sites of pBluescript®. The full length LRP5 cDNA was engineered into the XbaI-NotI sites of the vector pCMVSPORT6.0 (Life Technologies) by ligation of the XbaI-BamHI 5' section and the BamHI-NotI 3' section. The resulting plasmid, ZmaxGI_3AS, contains an insert of 5278 bp from the XbaI site to the NotI site of the vector's multiple cloning site. This clone is in the antisense orientation with respect to the CMV promoter present in the vector. LRP5 coding sequence begins at base 100 and ends at base 4947, followed by 331 bp of 3-primed UTR sequence including a 120 bp poly-A tail. This full length cDNA contains three DNA polymorphisms from the reference sequence (GenBank Accession No. AF077820) that do not alter the predicted amino acid sequence. These polymorphisms are at position 558 resulting in an A to G that maintains the proline residue; at position 3456 resulting in a G to A that maintains the valine residue; and, at position 4515 resulting in a G to C that maintains the leucine residue.

The sequence of ZMAXGI_3AS (FIG. 25) also contains a DNA polymorphism relative to SEQ ID NO. 1 at base 4088 resulting in a C (SEQ ID NO: 1 and Genbank Accession No: AB017498) to T change that results in an amino acid change at position 1330 of alanine to valine. This is consistent with the sequence determined in the wild-type allele from an affected member of the HBM kindred as well as with the published sequence of Genbank Accession No. AF077820. ZMAXGI_3AS also has 29 additional bases at the 5' end relative to SEQ ID NO: 1, as well as 129 bases at the 3' end consisting of an extra G, 120 bases of poly-A tract, and the NotI site.

Creation of the HBM Mutation G171V

The HBM mutation that results in a predicted amino acid change from glycine to valine at amino acid 171 was introduced into the full length human LRP5 cDNA (plasmid ZMAXGI_3AS) using PCR to change the G at position 611 to a T. Introduction of the HBM mutation was done using oligos (SEQ ID NO:728) 107335: (5'-CAGCGGCCTGGAG-GATGC-3') and (SEQ ID NO:729) 49513: (5'-CGGGTA-CATGTACTGGACAGCTGATTAGC-3'), which flank the endogenous NotI site of the LRP5 gene. This method creates a new PvuII site at the 3' end of the PCR product. A second PCR reaction was completed using oligos which introduce a ScaI site at the 5' end of the product and contains the endogenous SalI site of LRP5 in the 3-primed end. PCR products were purified using the QiaQuick® procedure (Qiagen Inc.); subcloned into the vector pCRII-TOPO (Invitrogen) as described above. Plasmid DNA was purified from single bacterial colonies and analyzed by restriction digest and subsequent sequence analysis, all as described above. The sequence-verified pCRII-TOPO clones were restriction digested with NotI-PvuII and ScaI-SalI, respectively. The resulting DNA fragments were size fractionated and purified as described above. These two fragments were then subcloned into the vector, pBluescript® that had been prepared by NotI-SalI digestion. Both PvuII and ScaI produce blunt ends when used to digest double stranded nucleic acids. Thus, the resulting ligated fragment fails to recreate either the PvuII or ScaI site and contains only the consensus LRP5 sequence, with the exception of the newly introduced HBM mutation. To introduce the mutation into the full length LRP5 gene, this resulting plasmid was digested with MscI and SalI, while the 5' region of LRP5 was obtained by XbaI-MscI digestion of LRP5 plasmid GTC.Zmax1_13. These two fragments were ligated together into XbaI-SalI digested pBluescript®, in effect creating a similar 1.366 kb XbaI-SalI fragment. The only difference being that this construct contains the HBM mutation described above. The full length HBM cDNA then was assembled into pCMVSPORT6.0 exactly as described above for the LRP5 gene, with the substitution of this newly created XbaI-SalI fragment containing the HBM mutation. The entire cDNA insert was verified by DNA sequence analysis and the introduction of the HBM mutation was confirmed.

The resulting plasmid, HBMGI_2AS (FIG. 24), contains an insert of 5,278 bp from the XbaI site to the NotI site of the vector's multiple cloning site. This clone is in the antisense orientation with respect to the CMV promoter in the vector. HBM coding sequence begins at base 100 and ends at base 4947, followed by 331 bp of 3-primed UTR sequence which includes a 120 bp poly-A tail. This full length cDNA contains three DNA polymorphisms from the reference sequence, which do not alter the amino acid sequence. These polymorphisms occur at position 558, resulting in an A to G change that maintains the proline residue; at position 3456 resulting in a G to A change that maintains the valine residue; and, at position 4515 resulting in a G to C change that maintains the leucine residue. Additionally, the HBM mutation is present at position 611 (G in LRP5 to T in HBM) which results in a predicted amino acid change of glycine to valine at amino acid position 171, as found in affected members of the HBM kindred. This insert sequence was used to generate the construct used for HBM over-expressing transgenic mice.

Transgene Preparation

The examples provided herein are illustrations of how transgenic animals can be prepared. Additional transgenic animals can be prepared as would be known in the art. See, for example, Glenn Monastersley et al., ed, *Strategies in Transgenic Animal Studies* (Amer. Soc. Microbiology 1995) and the references cited therein.

CMVβActin Promoter-HBM cDNA (HBMMCBA)

To prepare the CMVβactin-HBM construct, pCX-EGFP, a plasmid containing the chimeric CMVβactin promoter, was purified as a 4778 bp EcoRI fragment. Subsequently, the HBM cDNA was excised from HBMGI_2AS as a 4994 bp XbaI/DraI fragment, treated with Klenow fragment of DNA polymerase, ligated to EcoRI linkers, and digested with EcoRI. This fragment was then inserted into the EcoRI site of pCX-EGFP. A SpeI/HindIII 7265 bp CMVβactin-HBM fragment was purified for microinjection into mouse embryos.

Type I Collagen Promoter-HBM cDNA (HBMMTIC)

The rat type I collagen promoter-HBM construct was created by first replacing the pBS(SK-) (Stratagene) polylinker with another polylinker (i.e., comprising KpnI-SpeI-HindIII-BglII-NdeI-SalI-SmaI-EcoRI-PstI-BamHI-XbaI-ScaI-NcoI-ClaI-NotI-SacII-SacI), that is referred to as BS(SK-)A/D. The SV40 splice and poly (A)$_n$ XbaI-NcoI region (750 bp) from pcDNA I (Invitrogen, Inc.) was directionally cloned into BS(SK-)A/D. Next, a 4994 bp EcoRI HBM cDNA fragment (above) was cloned into the EcoRI site. A 3640 bp XbaI, type I collagen promoter fragment was subcloned into the XbaI site of BS(SK-) (Stratagene). The promoter fragment was then excised from BS(SK-) with SacII, blunt-ended with T4 DNA polymerase, digested with SpeI, and ligated into the HBM BS(SK-) A/D construct, which was digested with Nde I, blunted with T4 DNA polymerase, and digested with SpeI. A SpeI/ClaI 9435 bp type I collagen-HBM fragment was purified for microinjection into mouse embryos.

CMVβActin Promoter-LRP5 cDNA (Zmax1WTCBA)

The CMVβActin promoter-HBM cDNA construct from above was used to generate the final plasmid. The following three fragments were ligated together: 1) a 6.34 kb XbaI-KpnI backbone fragment from HBMMCBA; 2) a 0.64 kb XbaI-SapI fragment from HBMMCBA containing the 3' end of the bActin promoter and the 5' end of the HBM cDNA; and 3) a 2.8 kb SapI-KpnI fragment derived from the LRP5 cDNA that contains the wild-type sequence. A 7.2 kb SpeI-HindIII CMVβActin-LRP5 fragment was purified for micro-injection into mouse embryos.

Type I Collagen Promoter-LRP5 cDNA (Zmax1WTTIC)

The type I collagen-HBM cDNA construct from above was used to generate the final plasmid. The HBMMTIC plasmid was linearized with HindIII and cut with either SalI to yield a 8.52 kb HindIII-SalI fragment or SapI to yield a 2.98 kb SapI-HindIII fragment. A 2.8 kb SapI-SalI fragment from the LRP5 cDNA containing the wild-type sequence was then ligated to the above two fragments to yield the final plasmid. A 9.4 kb SpeI-ClaI type I collagen-LRP5 fragment was purified for micro-injection into mouse embryos.

Confirmation of Transgene Expression in Vitro

Plasmid constructs for HBMMCBA, HBMMTIC, Zmax1WTCBA and Zmax1WTTIC were transiently transfected into human osteoblast (HOB) cells to measure mRNA expression as a test for functionality.

Transient Transfections

HOB-02-02 cells are a clonal, post-senescent, cell line derived from the HOB-02-C1 cells (Bodine et. al, 1996, *J. Bone Miner. Res*. 11: 806-819). Like the parental cell line, the HOB-02-02 cells express the temperature-sensitive SV40 large T-antigen mutant, tsA209. Consequently, these cells proliferate at the permissive temperature of 34° C., but stop dividing at non-permissive temperatures of 37° C. or above. Also like the parental cell line, the HOB-02-02 cells are cultured with Growth Medium (D-MEM/F-12 containing 10% heat inactivated fetal bovine serum, 1% penicillin-streptomycin and 2 mM GlutaMAX-1) at 34° C. in a 5% $CO_2$/95% humidified air incubator (Forma Scientific, Marietta, Ohio).

For the transient transfections, the HOB-02-02 cells were seeded with Growth Medium at 400,000 cells/well into 6-well plates and incubated overnight at 34° C. The cells were transfected with 0.3 mg/well of either the CMVβActin-HBM expression plasmid, the Type I Collagen-HBM expression plasmid or the corresponding empty vectors using LipofectAMINE 2000 transfection reagent according to the manufacturer's instructions (Life Technologies, Rockville, Md.). After a 24 hr incubation at 34° C., the medium was changed, and the cells were incubated for an additional 24 hr at 39° C. At the end of this last incubation, the cells were rinsed with Hank's buffered salt solution. Total cellular RNA was then isolated using TRIzol® according to the manufacturer's instructions (GibcoBRL, Grand Island, N.Y.). The RNA was treated with RNase-free DNase in order to remove contaminating DNA as previously described (Bodine et al., 1997, *J. Cell. Biochem*. 65: 368-387).

TaqMan® Assay for mRNA Expression

TaqMan® primers and probes were chosen based on human and mouse LRP5 cDNA sequences. The selected sequences were designed to be gene-specific by analysis of an alignment of human and mouse LRP5 (Zmax1) sequences as illustrated in FIG. 26.

TaqMan® quantitative reverse transcriptase-polymerase chain reaction (RT-PCR) analysis of RNA isolated from human cells was performed as described by the manufacturer (PE Applied Biosystems, Foster City, Calif.) using the following primers and probe set:

Human Zmax1-1/HBM: (SEQ ID NOS:730-732)

Forward Primer:
5'-GTCAGCCTGGAGGAGTTCTCA-3'

Reverse Primer:
5'-TCACCCTTGGCAATACAGATGT-3'

Probe:
6-FAM-5'-CCCACCCATGTGCCCGTGACA-3'

Results from the experimental primers/probe set were normalized to human GAPDH levels using the multiplex protocol with the human GAPDH control kit from PE Applied Biosystems. Species-specific TaqMan® quantitative RT-PCR analysis of RNA isolated from murine cells and tissues was performed as described by the manufacturer (PE Applied Biosystems, Foster City, Calif.) using the following primers and probes sets:

Human Zmax-1/HBM-1: (SEQ ID NOS:733-735)

Forward Primer:
5'-CGTGATTGCCGACGATCTC-3'

Reverse Primer:
5'-TTCCGGCCGCTAGTCTTGT-3'

Probe:
6-FAM-5'-CGCACCCGTTCGGTCTGACGCAGTAC-3'

```
-continued
Mouse Zmax-1/HBM-1: (SEQ ID NOS:736-738)

Forward Primer:
5'-CTTTCCCCACGAGTATGTTGGT-3'

Reverse Primer:
5'-AAGGGACCGTGCTGTGAGC-3'

Probe:
6-FAM-5'-AGCCCCTCATGTGCCTCTCAACTTCATAG-3'
```

Results from the experimental primers/probe sets were normalized to 18S ribosomal RNA levels using the multiplex protocol with the 18S ribosomal RNA control kit from PE Applied Biosystems. A summary of these results is presented in FIGS. 17-20.

Production of Transgenic Mice

DNA Microinjection

Transgene fragments for micro-injection were first purified on 1% agarose gels according to the GELase protocol from Epicentre Technologies. Fragments were then further purified on cesium chloride density gradients and extensively dialyzed against 5 mM Tris (pH 7.4), and 0.1 mM EDTA.

Linearized DNA was microinjected into mouse embryos according to standard procedures. DNA was injected into primarily the male pronucleus of fertilized C57BL/6T mouse embryos. Injected embryos (n=20-35) were transferred to the oviduct (unilaterally) of day 0.5 post coitum pseudopregnant Swiss Webster embryo recipients. Offspring were tail-biopsied and genotyped at age 10-14 days.

Production of Gene-targeted Transgenic Mice

Gene Targeting Vectors and Probes

Two gene-targeting vectors were constructed for modification of the LRP5 gene in embryonic stem (ES) cells. The two constructs, illustrated in FIG. 16, designated as Zmax1-KI/KO A&B were designed to generate two types of mutations, a knock-out (KO) of the LRP5 gene and a Cre recombinase dependent knock-in (KI) of a nucleotide substitution in order to create a mouse model (i.e., glycine 170 to valine amino acid substitution in mouse LRP5, of the HBM kindred.

Both gene-targeting vectors were constructed using genomic DNA of the mouse genomic DNA BAC clone 473P5 (Genbank Accession No. AZ095413) containing the first five exons of the mouse LRP5 gene. This clone was isolated by Research Genetics (Huntsville, Ala.) from their mouse 129SvJ genomic BAC library using a polymerase chain reaction (PCR) screen for exon 3. A forward primer of the sequence (5'-GAGCGGGCAGGGATGGATGG-3')(SEQ ID NO:739) and a reverse primer of the sequence(5'-AGGTTG-GCACGGTGGATGAAGC-3')(SEQ ID NO:740) were used to amplify exon 3 by PCR; the following thermal cycling conditions were employed: for thirty cycles, 95° C. for 0.5 minute, 55° C. for 1 minute and 72° C. for 1 minute. Identity of this clone with mouse LRP5 was confirmed by sequencing exon 3 using the BAC clone DNA as template. PCR products were cloned using the pGEM-T-easy T/A cloning kit.

LRP5 Knock-in/Knock-out Vector

The organization of the genomic BAC clone 473P5 was characterized by Southern blot analysis using subcloned exon 1, exon 2 and exon 3 as probes and by sequencing the region spanning exon 1 through exon 5. Two different constructs were prepared for the LRP5 (Zmax1) KI/KO targeting. These constructs (A and B) differ only in flanking arms of homology. Construct (A) contains a 6.5 kb BstEII-XbaI 5' arm of homology and a 1 kb XbaI-EcoRI 3' arm of homology; whereas, construct (B) contains a 1 kb 5' arm of homology and a 6.0 kb 3' arm of homology. The constructs were prepared by ligating short and long arms of homology to a LoxP flanked cassette containing the neomycin resistance gene (MC1-Neo, Stratagene) and a synthetic transcriptional pause sequence (Promega).

Both Zmax1-KI/KO-targeting vectors (A and B) were modified to a G-to-T nucleotide substitution, encoding the G170V amino acid substitution, in exon 3. These modifications were introduced into by overlapping PCR mutagenesis using the wild type sequence of the short arm of homology as template. In addition, the 1 kb short arm of the Zmax1-KI/KO (B) targeting vector was modified to include a 5' terminal PmeI restriction recognition site. The 5' overlapping fragment was made using the forward primer of the sequence (5'-AAGCTT GTTTAAACTGGGCATGGTGGCACATGGTTGTAAT-3') (SEQ ID NO:741) and a reverse (mutagenic) primer of the sequence (5'-GGGCTTCC ACCCAGTCAGTCCAGTACATGTACCT-3') (SEQ ID NO:742). The thermal cycling conditions utilized for thirty cycles are 95° C. for 0.5 minute, 55° C. for 1 minute and 72° C. for 1 minute. The 3' fragment was made using the forward primer of the sequence (5'-CTGACTGGG TGGAAGCACCCCGGATCGAGC-3') (SEQ ID NO:743) and a reverse (mutagenic) primer of the sequence (5'-GAAT-TCATCGGTACCTGTGCGGCCGCTTCATTG-3') (SEQ ID NO:744). The thermal cycling conditions utilized for thirty cycles are 95° C. for 0.5 minute, 55° C. for 1 minute and 72° C. for 1 minute. The final overlapping PCR used 1 ml each of the 5' fragment and 3' fragment PCR reactions as template and amplification was performed using the forward and reverse primers of the 5' and 3' fragments respectively and the same thermal cycling parameters. The final PCR product was cloned using the pGEM-T-easy T/A cloning kit. The mutagenized exon 3 was excised from Zmax1-KI/KO (B) and transferred to Zmax1-KI/KO (A) as a 600 bp BsmBI-XbaI fragment.

Probes for screening for and characterization of Zmax1-KI/KO (A) gene targeted ES cell clones are prepared by subcloning restriction fragments of BAC clone 473P5. The 5' outside probe is a 400 bp Nde-BstEII fragment, and the 3' outside probe is a 500 bp EcoRI-BstXI fragment.

The outside probes for Zmax1-KI/KO (B) are prepared by PCR cloning genomic fragments flanking and immediately adjacent to the targeting vector region of homology. The 5' outside probe used for Zmax1-KI/KO (B) is a 498 bp fragment generated using the forward primer of the sequence (5'-TGAGATGTCCTGTCTGTGGC-3') (SEQ ID NO:745) and a reverse primer of the sequence (5'-TCCTTCCTTC-CCTACAGTTG-3')(SEQ ID NO:746). The thermal cycling conditions utilized with these probes for thirty cycles are: 95° C. for 0.5 minute, 55° C. for 1 minute and 72° C. for 1 minute. The 3' outside probe is a 600 bp fragment generated using the forward primer of the sequence (5'-CCTAAGGATCTCCT-TGTGTCTGTGG-3')(SEQ ID NO:747) and a reverse primer of the sequence (5'-CTGCAGCAGGTCAGTAGCCTGC-3') (SEQ ID NO:748). The thermal cycling conditions utilized with these probes for thirty cycles were: 95° C. for 0.5 minute, 55° C. for 1 minute and 72° C. for 1 minute. Both probes are specific for the LRP5 gene in genomic southern analysis. PCR products are cloned using the pGEM-T-easy T/A cloning kit.

A probe for ribonuclease protection analysis of LRP5 mRNA structure and transcription levels was prepared by PCR cloning a cDNA fragment containing exon 3 through exon 4. The PCR reaction used a complete cDNA as template, a forward primer of the sequence (5'-TGAGATGTCCT- GTCTGTGGC-3')(SEQ ID NO:749), a reverse primer of the sequence (5'-TCCTTCCTTCCCTACAGTTG-3') (SEQ ID NO:750) and the following thermal cycling conditions for thirty cycles; 95° C. for 0.5 minute, 55° C. for 1 minute and 72° C. for 1 minute. The PCR product is cloned using the pGEM-T-easy T/A cloning kit.

Gene Targeting in ES Cells

For gene targeting, embryonic stem (ES) cells are electroporated with 50 mg of linearized targeting vector and selected in 200 mg/ml G418 for 7-10 days beginning the day after electroporation. G418 resistant clones are picked, expanded and cryopreserved. Resistant clones were screened for homologous recombination by an EcoRI genomic Southern restriction fragment length analysis using the 5' outside probe, which detects the wild type and targeted alleles of LRP5 as 4 kb and 5 kb fragments, respectively. Gene targeted ES cell clones are thawed, expanded, and characterized by ScaI genomic restriction fragment length analysis using the 3' outside probe, which detects the wild type and targeted alleles of LRP5 as 9 kb and 8 kb fragments, respectively. Gene targeted clones are also characterized by sequence analysis of LRP5 exon 3 to ensure that the G to T substitution was included in homologous recombination.

Production of Gene Targeted Mice by Blastocyst Injection

To generate chimeric mice, gene targeted ES cell clones are thawed, expanded and 9-14 ES cells injected into the blastocoel of 3.5 post coitum (p.c.) host C57BL/6 blastocysts. Injected blastocysts (12-17) are then transferred unilaterally into the uterus of 2.5 p.c. pseudopregnant Swiss Webster embryo recipients and allowed to develop to term. Chimeric males are back-crossed to 129SvEv females and tested for transmission of the targeted allele by PCR geneotyping with primers specific to the neomycin resistance gene.

In Vitro Deletion of the Neomycin Resistance Cassette via Cre Recombinase

To generate LRP5 KI mice from the LRP5 KI/KO mice the Neomycin resistance (KO) cassette was deleted by micro injection of a Cre expressing plasmid (2 mg/ml) into the male pronucleus of LRP5 KI/KO pre-fusion zygotes. Deletion of the KO cassette was confirmed by PCR analysis of the cassette insertion site.

Genotyping Transgenic Mice

Genomic DNA was isolated from mouse tail snips by digestion in 500 ul buffer containing 50 mM Tris-HCl, (pH 7.2), 50 mM EDTA, (pH 8.0), 0.5% SDS and 0.8 mg/m proteinase K. Samples are incubated at 550 C with shaking overnight. A 10 µl aliquot was heat-inactivated at 99° C. for 5 minutes and diluted 1:20 in water. For PCR, 1 µl of the diluted DNA was amplified under the following conditions: Denature: 96° C. for 4.5 min; 45 cycles: 96° C. for 30 sec; 63° C. for 1 min; 72° C. for 1 min; Extension: 72° C. for 5 min; 40° C. hold.

The following primer sets are used for genotyping:

```
HBMMCBA:
5' primers: 296 bp fragment (SEQ ID NO:751)
forward:    5'-GCT TCT GGC GTG TGA CCG GCG-3'

(SEQ ID NO:752)
reverse:    5'-GCC GCACAG CGC CAG CAG CAG C-3'

3' primers: 400 bp fragment (SEQ ID NO:753)
forward:    5'-CAC CCA CGC CCC ACA GCC AGT A-3'
```

```
-continued
                                            (SEQ ID NO:754)
reverse:    5'-ATT TGC CCT CCC ATA TGT CCT TCC-3'

HBMMTIC:
5' primers: 382 bp fragment (SEQ ID NO:755)
forward:    5'-TTC CTC CCA GCC CTC CTC CAT CAG-3'

(SEQ ID NO:756)
reverse:    5'-GCC GCA CAG CGC CAG CAG CAG C-3'

3' primers: 524 bp fragment (SEQ ID NO:757)
forward:    5'-GAA TGG CGC CCC CGA CGA C-3'

(SEQ ID NO:758)
reverse:    5'-GCT CCC ATT CAT CAG TTC CAT AGG-3'
```

Confirmation of Genotype by Southern Analysis

Mouse genomic DNA was digested with EcoRI and probed with a 1.0 kb SalI-BamHI restriction fragment from the LRP5 cDNA. The probe hybridizes to a 5 kb fragment in transgene positive animals.

Phenotyping

Both in vivo and ex vivo assays are used to evaluate the phenotype in transgenic mice. Two strains of wild-type mice, namely C57BL/6 and 129 SvEv, are studied to provide control data for phenotypic evaluation in transgenic and gene-targeted mice. In addition, non-transgenic littermate animals are used as controls.

In Vivo Analysis pDXA: Wild-type and transgenic mice are anesthetized, weighed and whole-body X-ray scans of the skeleton generated using the LUNAR small animal PIXImus device. Scans are begun when the mice are weaned (i.e., at 3 weeks of age) and repeated at 2 week intervals. Wild-type animals are scanned at 3, 5, 7, 9, 11, 13, 15, 17, 19, 21, 23, 27, and 29 weeks. Scanning of transgenic animals would be performed for periods up to 17 weeks. Scans are analysed for BMD (bone mineral density), BMC (bone mineral content), TTM (total tissue mass), and % fat for various body regions.

Faxitron radiographs: Following pDXA scanning of anesthetized animals, an additional X-ray was taken using a Faxitron device allowing measurement of bone size.

Calcein labeling: Animals are dosed with 15 mg/kg calcein intraperitoneally on two consecutive occasions. The first dose was given 9 days before euthanasia and the second given 2 days before euthanasia allowing measurement of bone formation rate.

Ex Vivo Analysis

RNA isolation: Total RNA was isolated from tibia and other tissues using TRIzol® to determine mRNA expression.

pQCT: The right femur was cleaned of soft tissue and stored in 70% ethanol for determination of total and trabecular density of the distal metaphysis and cortical density of the mid-shaft.

MicroCT: The right femur was used to determine trabecular indices of the distal metaphysis.

Histology: The right femur was used to determine bone area and static and dynamic parameters of the distal metaphysis.

Bending strength: The left femur was cleaned of soft tissue and stored at −20° C. prior to analysis of 3-point bending strength of the mid-shaft.

Compressive strength of vertebra: The entire spine was removed from T10-L6-7. Soft tissue was left on and the spine frozen at −20° C. until analysis. Compressive strength was measured at the L5 vertebra.

Serum: Animals are euthanized and serum prepared from blood to measure total cholesterol, triglycerides, osteocalcin, and other biochemical surrogate markers.

Histological analysis: Examples include immunocytochemistry such as in situ hybridization of osteogenic markers and TUNEL staining of cells undergoing apoptosis.

Results

Confirmation of Expression from Transgenic Plasmid Constructs

The HBM (HBMMCBA and HBMMTIC) and wild-type (Zmax1WTCBA and Zmax1WTTIC) plasmid constructs were transiently transfected into HOB-02-02 cells, which have a very low endogenous level of LRP5 expression. Two days after transfection, RNA was isolated and TaqMan® quantitative RT-PCR was performed to determine the mRNA levels of LRP5/HBM in the cells. To control for contaminating plasmid DNA, PCR was performed with or without the prior RT step, in the absence of the RT step, only very low levels of LRP5/HBM mRNA were detected. However, with the RT step, a 1000-fold increase in HBM and LRP5 mRNA was observed in cells transfected with CMV-βActin-promoter constructs as compared to those transfected with the CMV-β-Galactosidase control. The type I collagen promoter constructs showed approximately 10-fold increases in HBM and LRP5 mRNAs, which is consistent with the weaker nature of this promoter compared to the CMVβActin promoter. See FIG. 17.

Species Specific Taqman® Reagents for HBM/LRP5 Expression

Species specific TaqMan® primer and probe sets for LRP5/HBM were developed. In a series of experiments using HOB cells and mouse MC-3T3-E1 osteoblastic cells, LRP5/HBM mRNA was measured in a mouse background, and vise versa. These reagents useful for the detection and quantization of species-specific expression. As demonstrated in FIG. 18, the primer sets are species specific in the mouse and human cell lines. Further, FIG. 19 demonstrates the quantitative measurement of human LRP5 RNA in a background of mouse RNA. These TaqMan® sets can be used to determine the levels of human or mouse HBM or LRP5 (or other HBM-like variant) message that are being expressed in the mouse transgenic lines.

The species-specific TaqMan® reagents are novel tools for the characterization of both endogenous LRP5 mRNA levels and human LRP5/HBM mRNA levels in the transgenic mouse tissues. These tools have several advantages over other conventional methods, such as Northern hybridization and standard RT-PCR. Some of these advantages are as follows: (1) specificity, since only a small region (<100 bps) is amplified primers and probes are chosen to sequence regions predicted to have no or minimal cross-reactivity; (2) speed, since the procedure is less labor intensive; (3) accuracy, since it is truly quantitative; and (4) sensitivity, since it requires only small amounts of starting material (i.e., RNA) and the signal-to-noise ratio is high. These advantages are especially important for analyzing mRNA levels in bone, because it is difficult to obtain large amounts of RNA from bone. Thus, the primer sets developed for TaqMan® analysis of a HBM and LRP5 expression are important embodiments of the present invention. One skilled in the art will recognize that the primers described here are preferred embodiments; modifications such as extension or truncation of a primer or base substitution are encompassed by the present invention so long as the resultant nucleic acid continues to perform substantially the same function.

HBM Expression in Transgenic Mice

Eight transgenic founder animals were produced for the CMVbActin (HBMMCBA) construct and a breeding program initiated to establish lines. Expression of mRNA determined by Taqman® analysis, shown in FIG. 20, showed variable levels of bone expression in 4 lines. In tibia, expression levels (relative to endogenous LRP5 in HOB-03-C5 cells) showed the following range: line 18 (×10-11 fold); line 2 (×7-10 fold); line 13 (×1-2 fold) and line 28 (×1 fold). Expression was also detected in other tissues as expected based on the known activity of the promoter. For lines 2 and 13, the highest levels of HBM expression were found in the heart. A Taqman® genotyping assay will screen for potential homozygous animals.

Six transgenic founder animals were produced for the type I collagen (HBMMTIC) construct, and a breeding program initiated to establish lines. Expression of mRNA was found in two lines initially tested. In line 19, expression was 7-8 fold and 19-20 fold greater than LRP5 in HOB-03-C5 cells in tibia and femur, respectively. In line 35, a low level of expression was detected in tibia and femur.

In Vivo pDXA Measurements of HBM Transgenic Mice

HBMMCBA Construct

Analysis of transgenic mice, illustrated in FIG. 21 (A-C), at the 5 week and 9 week time-points showed that one line tested to date had greater BMD values compared to control. At 5 weeks, HBMMCBA line 2 (n=11) BMD in femur, spine and total body was 21%, 24% and 10% greater respectively, than wild-type control. At 9 weeks (n=3), these increases in BMD amounted to 19%, 32% and 12%, respectively. Over 17 weeks, the percent increase in line 2 relative to wild-type controls was 10%, 11%, and 8%, respectively.

HBMMTIC Construct

Analysis of transgenic mice, illustrated in FIG. 21 (D-F), at the 5 week and 9 week time-points showed that two lines tested had significantly greater BMD values as compared to control animals. At 5 weeks, HBMMTIC line 19 (n=5) BMD in femur, spine and total body was 63%, 70% and 41% greater respectively than the wild-type control. At 9 weeks (n=2), these increases in BMD amounted to 52%, 64% and 37% respectively. Over 17 weeks, 35%, 40%, and 28%, respectively. At 5 weeks, HBMMTIC line 35 (n=1) BMD in femur, spine and total body was 4%, 47% and 6% greater, respectively than the wild-type control. At 9 weeks (n=3), these increases in BMD amounted to 32%, 43% and 18% respectively. At 17 weeks, the percent increases in BMD were 20%, 33% and 19%, respectively. Two additional HBM transgenic lines 188 and 189 where HBM expression is driven by the type I collegen promoter have been shown to have a HBM phenotype. Over 17 weeks, line 188 demonstrates a 23%, 35%, and 22% increase in BMD for femur, spine and total bone.

Overall, the BMD results from the transgenic mice show similarities in magnitude to the phenotype observed in the HBM affected kindred (Johnson et al., 1997, *Am. J. Hum. Genetics*, 60:1326-1332). For example, spinal BMD measured in affected individuals is approximately 34-63% greater than non-affected family members. The data for spinal BMD from the transgenic animals ranges from ~30-70% greater than normal at 9 weeks of age.

Ex Vivo Analysis of Transgenic Mice

In order to further examine increases in bone density that were detected in select transgenic lines through monitoring of the animals by non-invasive bone imaging, necropsies were performed on animals of these lines at 5 and 9 weeks of age for direct bone densitometric and histologic analysis. The left femur was isolated, cleaned and positioned in an XCT Research peripheral Quantitative Computed Tomograph (pQCT; Stradtec Medizintechnik, Pforzheim, Germany). The distal end of the femur was located and pQCT scanning was initiated 2.5 mm proximal from this point for total and trabecular measurements. The pQCT scan for cortical measurements was initiated 3.5 mm proximal from the first scan (i.e., 6 mm proximal from the distal end). The pQCT scans were 0.5 mm thick, had a voxel (i.e., three dimensional pixel) size of 0.07 mm, and consisted of 360 projections through the slice. After the scans were completed, the images were displayed on the monitor and a region of interest, including the entire femur for each scan, was outlined. The soft tissue was automatically removed using an iterative algorithm, and the density of the remaining bone (total density) in the first slice was determined. The outer 55% of the bone was then peeled away in a concentric spiral and the density of the remaining bone (trabecular density) of the first slice was reported in $mg/cm^3$. In the second slice, the boundary between cortical and trabecular bone was determined using an iterative algorithm, and the density of the cortical bone was determined.

Analysis of Line 2 F1 CMVβActin-HBM 5 week old transgenic animals revealed that total density, trabecular density and cortical density, were 20%, 37% and 4% higher, respectively, in the transgenic male mice versus the non-transgenic males. At later timepoints, the difference between the transgenic and non-transgenic animals in this line is diminished. However, in type I collagen-HBM transgenic males at 5 weeks old from Line 19, an even more dramatic increase in bone density over their non-transgenic littermates was evident. Total density, trabecular density and cortical density were 53%, 104% and 5% higher, respectively. In the Line 19 animals, the phenotype was found to be maintained beyond 9 weeks of age with elevated total and trabecular bone density as seen in Table 7. At 17 weeks, total and trabecular density were increased 46%, 202%, respectively. The effects on the total trabecular parameters in line 19 at all three time points were statistically significantly higher (p<0.001). A somewhat different pattern of bone phenotypic expression was evident from males of type I collagen-HBM transgenic Line 35. At 5 weeks of age total, trabecular and cortical density were only marginally higher (7%, 4% and 4%, respectively). However, at 9 weeks of age a clear and statistically significant increase in these parameters became evident as seen in Table 7. Total and trabecular bone densities remain elevated in Line 35 through 17 weeks of age.

Two additional HBM transgenic lines with the type I collagen promoter have been studied that show dramatic high bone density phenotypes similar to Line 19. In males from both line 188 and 189, total bone density was increased by 40% relative to non-transgenic animals. Trabecular bone density was increased 75% at 9 weeks of age. At 17 weeks, total and trabecular density of Line 188 males was 42% and 161% above control animals such as non-transgenic littermates. These values are consistent with the effects seen in Line 19 at this age. Females in Line 188 show 36% and 144% increases at 9 weeks and 26% and 148% increases in total and trabecular bone density respectively. Females from Line 189 had total and trabecular densities that were increased by 27% and 64% at 9 weeks, and 15% and 84% at 26 weeks of age.

The occurrence of different patterns of age-related expression of the phenotype is not unexpected, particularly with the "bone specific" type I collagen transgene, which is influenced by stage of bone cell differentiation. Both Line 2 and Line 19 animals at 5 weeks of age express comparable levels of HBM mRNA in tibia samples, and these levels are significantly greater (>7-8-fold) than other lines that show no apparent bone phenotype at this age. Line 19, which is driven by the type I collagen promoter, unlike line 2, shows very low expression of the transgene in tissues other than bone. At 5 weeks of age, Line 35 animals show low level expression in bone and none in other tissues. Immunohistochemistry of calvarial bone sections using an HBM/LRP5 specific antibody reveals much more intense staining in bone cells of transgenic animals from Lines 2 and 19 at 5 weeks of age and from Line 35 at 9 weeks of age versus their non-transgenic littermates.

The findings revealed by pQCT analysis were further examined under greater resolution using μCT instrumentation (Scanco). The femur was positioned such that the region being imaged includes the distal end of the femur extending approximately 4 mm proximally with the view being perpendicular to the axis of the articulating cartilage. The reference line for beginning the μCT measurement was placed to minimally overlap the growth plate and extends proximally for 200 scan slices (9 mm thickness). After completing the μCT measurement, the first slice in which the condyles have fully merged was identified. A region of interest was outlined to include a maximum amount of the trabecular space, while excluding the cortex. For the first thirty slices, regions of interest were drawn every five slices and merged. For the remaining 105 slices, regions of interest were drawn every 10-20 slices. The more regular the trabecular space, the less frequently a region of interest needed to be drawn. Each region of interest was merged with its predecessor after it was drawn. After regions of interest had been established for all 135 slices, three dimensional evaluation was performed using a threshold setting of 350.

The increased bone densities identified by pQCT were confirmed and extended by μCT to include elements of bone architecture. In the Line 2 transgenic animals, μCT bone volume/total volume, connectivity density and trabecular thickness were 50%, 83% and 12% higher, respectively. Both the connectivity density and trabecular thickness indices suggest that the increased density is also associated with increased structural strength. Bone surface/bone volume was lower by 17% in the transgenic males, which may suggest that there may be fewer resorptive surfaces and pits. The trabecular bone response was further confirmed by histological evaluation of non-decalcified, Goldner's stained sections, which revealed 36% greater bone mineral area in the distal femoral metaphysis of the transgenic males. Dynamic histomorphometric analysis revealed that a substantial increase in bone mineral apposition rate (+100%), as determined by calcein double labeling, may be partially responsible for the increased bone in the transgenics. The dramatic effects evident by pQCT on trabecular bone in Line 19 were supported by μCT evaluation where bone volume/total volume, trabecular number, trabecular thickness and connectivity density were found to be 130%, 45%, 30% and 121% higher, respectively, in the transgenic males. All of these effects were statistically significant with p<0.01. The bone phenotype seen at 5 weeks of age in Line 19 was maintained in 9 week-old animals where bone volume/total volume, trabecular number and connectivity density were significantly higher than in the non-transgenic littermates as seen in Table 7.

μCT analysis of the Line 35 transgenics revealed a somewhat different pattern than the other two lines. In contrast to only modestly increased density indicated by pQCT in 5 week-old females from Line 35, a statistically significant effect (p<0.01) was seen with μCT, which has greater image resolution and encompasses a larger volumetric sample. Bone volume/total volume, trabecular thickness and connectivity density were 35%, 9% and 27% higher. A similar result was seen in 5 week-old males from Line 35 where bone volume/total volume and connectivity density increases of 37% and 45%, respectively, were evident by μCT analysis, where only slight increases were revealed by pQCT. The differences between the Line 35 transgenic males and their non-transgenic littermates appeared to increase with age such that statistically significant increases in total density (28%) and trabecular density (52%) were evident by pQCT at 9 weeks of age. The μCT results support an age-related divergence in bone phenotype in this line and show that differences between transgenic and non-transgenic animals. In terms of bone volume/total volume and connectivity density, these parameters more than doubled those seen at 5 weeks to 97% and 188%, respectively. The bone volume increases seen in the transgenic animals is in agreement with a significant increase in this parameter that was detected in a bone biopsy sample from an adult male affected member of the HBM kindred. The other parameters that were found to be affected in the transgenic lines may reflect changes that lead to an increased peak/adult bone mass, which in this strain of mice occurs between the ages of 17-20 weeks.

Immunohistochemistry of the calvaria from Line 19 has revealed strong expression of the transgene in pre-osteoblasts and osteoblastic cells lining the periosteum, as well as in osteocytes present in mineralized bone. Periosteal osteoblasts in the transgenics appeared plump and cuboidal, indicative of cells actively secreting extracellular matrix. In contrast, periosteal cells of the nontransgenic littermates appeared as flat, lining cells. Staining for alkaline phosphatase, an osteoblast differentiation and functional marker, was elevated confirming the active secretory status of the cells in the transgenics compared to the controls. Further analysis has revealed a reduced number of TUNEL-positive osteocytes, osteoblasts and stromal cells in transgenic mouse calvaria suggesting a reduction in apoptosis. In calvariae from 9 week-old male non-transgenic mice there were 30.9±1.8 ((n=9) apoptotic osteoblasts/stromal cells per $mm^2$ were whereas in calvariae from HBM transgenics there were 11.6±2.8 (n=9) apoptotic osteoblast/stromal cells per $mm^2$. Taken together these results indicate that the increased BMD in the transgenics is due to increased osteoblast number and activity, which could in part be due to their increased functional lifespan.

The bone density and bone architectural changes seen in the over-expressing transgenic lines would suggest potentially greater bio-mechanical strength. This was tested directly by evaluating 3-point bending strength of femurs from 5 week old Line 19 males. The femora were cleaned of soft tissue and the femoral length measured using a digital caliper. Periosteal and endosteal circumferences, as well as cortical thickness, were measured 6 mm from the distal end of the bone using pQCT. The femur was then placed on a fixture so that the center of mid-shaft was at an equal distance from fixed supports located 5 mm apart. The cross bar of an Instron 5543 load device was placed over the mid-shaft and a force applied at a speed of 1 mm/minute until fracture occurred. A force vs. displacement curve was generated and peak load determined using Instron Merlin software. There was a 75% increase (p<0.01) in strength that appears to be due to an increase in periosteal circumference leading to an increase in cortical thickness. Thus, it appears that the changes in bone density and bone geometry, as seen in the HBM transgenic animals, do translate into increases in biomechanical strength.

In view of the association of HBM/LRP5 within the class of LDL related receptor proteins, it was of interest to determine whether the mutation might affect lipid profiles. Indeed, lipid studies in the HBM kindred (i.e., 8 affected and 7 unaffected members) have revealed that triglyceride and VLDL levels are statistically lower in the affected members. Serum samples from the transgenic lines were analyzed on a Hitachi 911 instrument using Boehringer Mannheim (for Cholesterol) and Roche (for triglycerides) reagents. The cholesterol was measured via o-quinone imine dye (which is formed following enzymatic reactions with cholesterol) photometrically at 505 nm at 37° C. Enzymatic methods for triglyceride measurements are based on determination of the glycerol part of triglyceride after hydrolysis of triglycerides and fatty acids. The end dye product of enzymatic reaction was measured at 505 nm. In 5 week old male Line 2 transgenics, although serum cholesterol was only slightly reduced, serum triglyceride levels were reduced by 26% in the transgenics versus their non-transgenic littermates. In a limited sample of Line 2 animals at 9 weeks of age, triglyceride levels remained 20% lower. Similarly, at 5 weeks of age triglyceride levels in male transgenics from Line 19 were 32% lower. In contrast, at 5 weeks of age both male and female transgenics of Line 35 did not have lower triglyceride levels. The fact that the 5 week old Line 35 animals did have statistically greater bone volume/total volume suggests that the lipid change may not be directly related to the skeletal phenotype. This would appear to be supported by the fact that the Line 35 animals at 9 weeks of age had only slightly reduced triglyceride levels (11%) but exhibited substantially higher bone density than at 5 weeks of age. Due to the different levels and sites of expression of the transgene in these lines we can not rule out the possibility that serum lipid levels could serve as a surrogate marker for agents favorably affecting a bone phenotype through HBM/LRP5.

These and other transgenic lines based on HBM or HBM-like genes will serve as valuable models for exploring the nature of bone homeostasis. Bone density in all species accommodates to its customary loading conditions. In the HBM kindred and in the transgenic lines, the sensor/effector systems of the skeleton appear to perceive greater load signals resulting in greater bone density. Experimental models have been established showing that increased bone loading can lead to increased bone density and that unloading or disuse leads to a loss of bone density. Evaluating the histological, biochemical and genetic responses of the skeleton of the transgenic animals in these experimental paradigms will yield much information regarding the sensor/effector system responsible for bone homeostasis. The application of the transgenic animals in other established models of altered bone turnover, including but not limited to steroid deficiency-induced osteopenia and aging-related osteopenia will provide further insight into the role of LRP5 in bone homeostasis and the nature of the favorable changes induced by the HBM mutation.

LRP5 Over-expression in Transgenic Mice

In order to evaluate the role of overexpression of wild-type LRP5 and for contrast with the effects of HBM, transgenic mice have been created that express LRP5 driven by the type I collagen promoter. Statistically increased total and trabecular femoral bone density is observed at 9 weeks of age in one of these lines (LRPWWTTIC-19). Although not as great as seen in the HBM transgenic lines, the observations are supported by μCT measurements that show significant increases in bone volume and connectivity density. A comparison of percentage changes in skeletal parameters for HBM and LRP5 transgenic mice relative to non-transgenic mice at 9 weeks is shown in Table 7 below:

TABLE 7

| Line (Gender) | Total Density | Trabecular Density | BV/TV | Connectivity Density | Trabecular # | Trabecular Thickness |
| --- | --- | --- | --- | --- | --- | --- |
| HBM-19 (M) | 60 | 146 | 252 | 348 | 55 | 47 |
| HBM-19 (F) | 59 | 222 | 206 | 193 | 56 | 44 |
| HBM-35 (M) | 28 | 52 | 97 | 188 | 31 | 11 |
| LRP5-19 (F) | 10 | 41 | 35 | 47 | 15 | 4.3 |

Further evaluation of another LRP5 transgenic line did not show significant pQCT values as a group has revealed on individual analysis that the level of expression of the transgene is associated with the skeletal phenotype parameters. While overexpression of the wild type receptor produces an anabolic bone phenotype, the phenotypic change is greatly magnified by the HBM mutation.

HBM Gene-targeting

The LRP5 KI/KO gene-targeting vector is electroporated into 129 SvEv, C57BL/6 ES and 129 ES cells. Restriction fragment length analysis of genomic DNA and sequencing of PCR amplified fragments can be used to identify gene targeted clones. The knock-in version of the gene-targeting vector allows for the introduction of the HBM mutation into the endogenous LRP5 genomic locus with minimal impact on the mouse genome. It permits the production of the HBM protein in a more natural environment, i.e. not in an over-expression model such as the transgenic mice or transfected cell lines. The knock-out version of the gene-targeting vector was engineered to contain a transcriptional stop sequence that has the potential to result in loss of one functional LRP5 allele. Breeding heterozygous animals with this mutation leads to the production of embryos homozygous for the null allele. In a different design of the gene-targeting vector, lox P sites can be positioned to facilitate production of a conditional knock-out of the endogenous LRP5 gene. In the presence of Cre recombinase, a critical region of the LRP5 gene would be deleted in between the lox P sites, thus resulting in the potential loss of one functional allele. Animal breeding would then be used to create homozygotes with a null allele. Other recombinase enzyme systems, such as flp recombinase in combination with cognate frt sites, could be used to create the deletion. The recombinase could be administered in a number of ways as described earlier, including plasmid injection into embryos and use of transgenic animals expressing Cre. The promoter used to drive expression of Cre could be chosen in a manner that would result in ubiquitous or tissue-specific deletion of the LRP5 gene thus resulting in a conditional knockout. In a further embodiment expression of the Cre enzyme itself could be made conditional using inducible systems such as GeneSwitch and Tetracycline paradigms.

LRP6 Gene Targeted Knock Out Mice

LRP6 knock-out mice were generated using Omnibank® embryonic stem (ES) cells carrying a gene trap vector which inserted into the first intron of the LRP6 gene. The insert location was determined to be the LRP6 gene by an Omnibank Sequence Tag (OST) generated by reverse transcription PCR (RT-PCR) of a fusion transcript comprised of 5' gene trap vector sequence spliced to the host gene transcript 3' of the insertion site. The gene trap vector functionally knocks out the mouse LRP6 gene by forced spicing of LRP6 exon 1 to the IRES-LacZ-PolyA element of the gene trap, preventing transcrition of LRP.

Chimeric mice were generated with ES cells, identified as OST38808, by injection into C57BL/6 albino host blastocyts which were then transferred to pseudopregnant females and allowed to develop through birth. Germline chimeras were backcrossed to 129SvEVBrd strain mice to maintain the knockout allele of LRP6 on an inbred 1298SvEvBrd genetic background. Germline transmission of the LRP6-KO allele was identified by PCR amplification of a gene trap specific sequence. Heterozygous LRP6-KO mating pairs were used for continued breeding. The genotype of wt and LRP6-KO progeny is determined by tail DNA PCR.

Measurements of bone density at 9 weeks of age in female heterozygous knock-out mice showed significant ($p<0.05$) decreases in bone volume, trabecular number, and trabecular thickness in transgenic mice compared to control non-transgenic female mice as measured by $\mu$CT. In male mice, statistically significant differences between transgenic and control mice appeared at 17 weeks. Differences in bone density between transgenic and non-transgenic mice continued to increase in measurements taken at 26 weeks. These results are consistent with the hypothesis that LRP6 is also involved in modulating bone density and is a target for development of therapies and drugs. Accordingly, LRP6 transgenic animals and transgenic animals expressing bone modulating variants of LRP6 are contemplated within the scope of the invention.

Uses of Transgenic Animals and Cells

The transgenic animals and cells of the present invention are useful tools in methods for identifying surrogate markers for the HBM phenotype. The surrogate markers provided by the present invention are also useful tools for the assessment and screening of prospective treatments. Individuals carrying the HBM gene have elevated bone mass. The HBM gene causes this phenotype by altering the activities, levels, expression patterns, and modification states of other molecules involved in bone development. Using a variety of established techniques, it is possible to identify molecules, preferably proteins or mRNAs, whose activities, levels, expression patterns, and modification states are different between systems containing the LRP5 gene and systems containing the HBM gene. Such systems can be, for example, cell-free extracts, cells, tissues or living organisms, such as mice or humans. For a mutant form of LRP5, a complete deletion of LRP5, mutations lacking the extracellular or intracellular portion of the protein, or any other mutation in the LRP5 gene may be used. It is also possible to use expression of antisense LRP5 RNA or oligonucleotides to inhibit production of the LRP5 protein. For a mutant form of HBM, a complete deletion of HBM, mutations lacking the extracellular or intracellular portion of the HBM protein, or any other mutation in the HBM gene may be used. It is also possible to use expression of antisense HBM RNA or oligonucleotides or RNA interference methodologies to inhibit production of the HBM protein.

Molecules identified by comparison of LRP5 systems and HBM systems can be used as surrogate markers in pharmaceutical development or in diagnosis of human or animal bone disease. Alternatively, such molecules may be used in treatment of bone disease. See, Schena et al., *Science*, 270: 467-470 (1995).

For example, a transgenic mouse carrying the HBM gene in the mouse homologue locus is constructed. A mouse of the genotype HBM/+ is viable, healthy and has elevated bone mass. To identify surrogate markers for elevated bone mass, HBM/+ (i.e., heterozygous) and isogenic +/+ (i.e., wild-type) mice are sacrificed. Bone tissue mRNA is extracted from each animal, and a "gene chip" corresponding to mRNAs expressed in the +/+ individual is constructed. mRNA from different tissues is isolated from animals of each genotype, reverse-transcribed, fluorescently labeled, and then hybridized to gene fragments affixed to a solid support. The ratio of fluorescent intensity between the two populations is indicative of the relative abundance of the specific mRNAs in the +/+ and HBM/+ animals. Alternatively, mRNA may be isolated from wild-type and transgenic animals. cDNA prepared from these samples is transcribed in vitro to obtain labeled mRNA for use on custom made or commercially available gene array chips such as are manufactured by Affymetrix. Sets of genes with altered expression as a function of phenotype may be identified be a variety of routine computational analyses. Genes encoding mRNA over- and under-expressed relative to the wild-type control are candidates for genes coordinately regulated by the HBM gene.

One standard procedure for identification of new proteins that are part of the same signaling cascade as an already-discovered protein is as follows. Cells are treated with radioactive phosphorous, and the already-discovered protein is manipulated to be more or less active. The phosphorylation state of other proteins in the cell is then monitored by polyacrylamide gel electrophoresis and autoradiography, or similar techniques. Levels of activity of the known protein may be manipulated by many methods, including, for example, comparing wild-type mutant proteins using specific inhibitors such as drugs or antibodies, simply adding or not adding a known extracellular protein, or using antisense inhibition of the expression of the known protein (Tamura et al., *Science*, 280(5369): 1614-7 (1998); Meng, *EMBO J.*, 17(15):4391-403 (1998); Cooper et al., *Cell*, 1:263-73 (1982)).

In another example, proteins with different levels of phosphorylation are identified in TE85 osteosarcoma cells expressing either a sense or antisense cDNA for LRP5. TE85 cells normally express high levels of LRP5 (Dong et al., *Biochem. & Biophys. Res. Comm.*, 251:784-790 (1998)). Cells containing the sense construct express even higher levels of LRP5, while cells expressing the antisense construct express lower levels. Cells are grown in the presence of $^{32}$P, harvested, lysed, and the lysates run on SDS polyacrylamide gels to separate proteins, and the gels subjected to autoradiography (Ausubel et al., *Current Protocols in Molecular Biology*, John Wiley & Sons (1997)). Bands that differ in intensity between the sense and antisense cell lines represent phosphoproteins whose phosphorylation state or absolute level varies in response to levels of LRP5. As an alternative to the $^{32}$P-labeling, unlabeled proteins may be separated by SDS-PAGE and subjected to immunoblotting, using the commercially available anti-phosphotyrosine antibody as a probe (Thomas et al., *Nature*, 376(6537):267-71 (1995)). As an alternative to the expression of antisense RNA, transfection with chemically modified antisense oligonucleotides can be used (Woolf et al., *Nucleic Acids Res.*, 18(7):1763-9 (1990)).

Many bone disorders, such as osteoporosis, have a slow onset and a slow response to treatment. It is therefore useful to develop surrogate markers for bone development and mineralization. Such markers can be useful in developing treatments for bone disorders, and for diagnosing patients who may be at risk for later development of bone disorders. Examples of preferred markers are N- and C-terminal telopeptide markers described, for example, in U.S. Pat. Nos. 5,455,179, 5,641,837 and 5,652,112, the disclosures of which are incorporated by reference herein in their entirety. In the area of HIV disease, CD4 counts and viral load are useful surrogate markers for disease progression (Vlahov et al., *JAMA*, 279(1):35-40 (1998)). There is a need for analogous surrogate markers in the area of bone disease.

A surrogate marker can be any characteristic that is easily tested and relatively insensitive to non-specific influences. For example, a surrogate marker can be a molecule such as a protein or mRNA in a tissue or in blood serum. Alternatively, a surrogate marker may be a diagnostic sign such as sensitivity to pain, a reflex response or the like.

In yet another example, surrogate markers for elevated bone mass are identified using a pedigree of humans carrying the HBM gene. Blood samples are withdrawn from three individuals that carry the HBM gene, and from three closely related individuals that do not. Proteins in the serum from these individuals are electrophoresed on a two dimensional gel system, in which one dimension separates proteins by size, and another dimension separates proteins by isoelectric point (Epstein et al., *Electrophoresis*, 17(11):1655-70 (1996)). Spots corresponding to proteins are identified. A few spots are expected to be present in different amounts or in slightly different positions for the HBM individuals compared to their normal relatives. These spots correspond to proteins that are candidate surrogate markers. The identities of the proteins are determined by microsequencing, and antibodies to the proteins can be produced by standard methods for use in diagnostic testing procedures. Diagnostic assays for HBM proteins or other candidate surrogate markers include using antibodies described in this invention and a reporter molecule to detect HBM in human body fluids, membranes, bones, cells, tissues or extracts thereof. The antibodies can be labeled by joining them covalently or noncovalently with a substance that provides a detectable signal. In many scientific and patent literature, a variety of reporter molecules or labels are described including radionuclides, enzymes, fluorescent, chemi luminescent or chromogenic agents (U.S. Pat. Nos. 3,817,837; 3,850,752; 3,939,350; 3,996,345; 4,277,437; 4,275,149; and 4,366,241). The transgenic or genetically modified animals can also serve in a method for surrogate marker identification.

Using these antibodies, the levels of candidate surrogate markers are measured in normal individuals and in patients suffering from a bone disorder, such as osteoporosis, osteoporosis pseudoglioma, Engelmann's disease, Ribbing's disease, hyperphosphatasemia, Van Buchem's disease, melorheostosis, osteopetrosis, pychodysostosis, sclerosteosis, osteopoikilosis, acromegaly, Paget's disease, fibrous dysplasia, tubular stenosis, osteogenesis imperfecta, hypoparathyroidism, pseudohypoparathyroidism, pseudopseudohypoparathyroidism, primary and secondary hyperparathyroidism and associated syndromes, hypercalciuria, medullary carcinoma of the thyroid gland, osteomalacia and other diseases. Techniques for measuring levels of protein in serum in a clinical setting using antibodies are well established. A protein that is consistently present in higher or lower levels in individuals carrying a particular disease or type of disease is a useful surrogate marker.

A surrogate marker can be used in diagnosis of a bone disorder. For example, consider a child that presents to a physician with a high frequency of bone fracture. The underlying cause may be child abuse, inappropriate behavior by the child, or a bone disorder. To rapidly test for a bone disorder, the levels of the surrogate marker protein are measured using the antibody described above.

Levels of modification states of surrogate markers can be measured as indicators of the likely effectiveness of a drug that is being developed. It is especially convenient to use surrogate markers in creating treatments for bone disorders, because alterations in bone development or mineralization may require a long time to be observed. For example, a set of bone mRNAs, termed the "HBM-inducible mRNA set" is found to be overexpressed in HBM/+ mice as compared to +/+ mice, as described above. Expression of this set can be used as a surrogate marker. Specifically, if treatment of +/+ mice with a compound results in overexpression of the HBM-inducible mRNA set, then that compound is considered a promising candidate for further development.

This invention is particularly useful for screening compounds by using the LRP5 or HBM protein or binding fragment thereof in any of a variety of drug screening techniques.

The LRP5 or HBM protein or fragment employed in such a test may either be free in solution, affixed to a solid support, or borne on a cell surface. One method of drug screening utilizes eukaryotic or prokaryotic host cells which are stably transformed with recombinant nucleic acids expressing the protein or fragment, preferably in competitive binding assays. Such cells, either in viable or fixed form, can be used for standard binding assays. One may measure, for example, for the formation of complexes between a LRP5 or HBM protein or fragment and the agent being tested, or examine the degree to which the formation of a complex between a LRP5 or HBM protein or fragment and a known ligand is interfered with by the agent being tested.

Thus, the present invention provides methods of screening for drugs comprising contacting such an agent with a LRP5 or HBM protein or fragment thereof and assaying (i) for the presence of a complex between the agent and the LRP5 or HBM protein or fragment, or (ii) for the presence of a complex between the LRP5 or HBM protein or fragment and a ligand, by methods well known in the art. In such competitive binding assays the LRP5 or HBM protein or fragment is typically labeled. Free LRP5 or HBM protein or fragment is separated from that present in a protein:protein complex, and the amount of free (i.e., uncomplexed) label is a measure of the binding of the agent being tested to LRP5 or HBM or its interference with LRP5 or HBM: ligand binding, respectively.

Another technique for drug screening provides high throughput screening for compounds having suitable binding affinity to the LRP5 or HBM proteins and is described in detail in WO 84/03564. Briefly stated, large numbers of different small peptide test compounds are synthesized on a solid substrate, such as plastic pins or some other surface. The peptide test compounds are reacted with LRP5 or HBM proteins and washed. Bound LRP5 or HBM protein is then detected by methods well known in the art. Purified LRP5 or HBM can be coated directly onto plates for use in the aforementioned drug screening techniques. However, non-neutralizing antibodies to the protein can be used to capture antibodies to immobilize the LRP5 or HBM protein on the solid phase.

This invention also contemplates the use of competitive drug screening assays in which neutralizing antibodies capable of specifically binding the LRP5 or HBM protein compete with a test compound for binding to the LRP5 or HBM protein or fragments thereof. In this manner, the antibodies can be used to detect the presence of any peptide that shares one or more antigenic determinants of the LRP5 or HBM protein.

A further technique for drug screening involves the use of host eukaryotic cell lines or cells (such as described above) that have a nonfunctional LRP5 or HBM gene. These host cell lines or cells are defective at the LRP5 or HBM protein level. The host cell lines or cells are grown in the presence of drug compound. The rate of growth of the host cells is measured to. determine if the compound is capable of regulating the growth of LRP5 or HBM defective cells.

The goal of rational drug design is to produce structural analogs of biologically active proteins of interest or of small molecules with which they interact (e.g., agonists, antagonists, inhibitors) in order to fashion drugs which are, for example, more active or stable forms of the protein, or which, e.g., enhance or interfere with the function of a protein in vivo. See, e.g., Hodgson, *Bio/Technology*, 9:19-21 (1991). In one approach, one first determines the three-dimensional structure of a protein of interest (e.g., LRP5 or HBM protein) or, for example, of the LRP5- or HBM-receptor or ligand complex, by x-ray crystallography, by computer modeling or most typically, by a combination of approaches. Less often, useful information regarding the structure of a protein may be gained by modeling based on the structure of homologous proteins. An example of rational drug design is the development of HIV protease inhibitors (Erickson et al., *Science*, 249:527-533 (1990)). In addition, peptides (e.g., LRP5 or HBM protein) are analyzed by an alanine scan (Wells, *Methods in Enzymol.*, 202: 390-411 (1991)). In this technique, an amino acid residue is replaced by Ala, and its effect on the peptide's activity is determined. Each of the amino acid residues of the peptide is analyzed in this manner to determine the important regions of the peptide.

It is also possible to isolate a target-specific antibody, selected by a functional assay, and then to solve its crystal structure. In principle, this approach yields a pharmacore upon which subsequent drug design can be based. It is possible to bypass protein crystallography altogether by generating anti-idiotypic antibodies (anti-ids) to a functional, pharmacologically active antibody. As a mirror image of a mirror image, the binding site of the anti-ids would be expected to be an analog of the original receptor. The anti-id could then be used to identify and isolate peptides from banks of chemically or biologically produced banks of peptides. Selected peptides would then act as the pharmacore.

Thus, one may design drugs which have, for example, desired LRP5 or HBM protein activity or stability, or which act as inhibitors, agonists, antagonists, etc. of LRP5 or HBM protein activity. By virtue of the availability of cloned LRP5 or HBM sequences, sufficient amounts of the LRP5 or HBM protein may be made available to perform such analytical studies as x-ray crystallography. In addition, the knowledge of the LRP5 or HBM protein sequence provided herein will guide those employing computer modeling techniques in place of, or in addition to x-ray crystallography.

Identified drug candidates (known as "leads") may be further studied by use of transgenic animals. The transgenic animals of the present invention are useful for creating an animal model of bone density modulation which may be used to test and refine drug leads. The transgenic animals described above represent a single example of the LRP5 and HBM or HBM-like transgenic animals contemplated herein. One skilled in the art is aware of variations and the considerations which will be routinely applied in modifying the present invention to a specific purpose. Examples of the development of transgenic animal models are given for example in *Strategies in Transgenic Animal Science* (1995, Monastersky and Robl Eds., Washington, DC: American Society for Microbiology) and references therein which are all incorporated herein by reference in their entirety.

As an example, at least two groups of transgenic animals can be created as described, so that one group expresses HBM and another group expresses LRP5. These animals can be treated with the candidate drug for some time spanning from a few days to the remainder of the animal's life-span. The animals are monitored for changes in bone mass and/or surrogate markers for the HBM phenotype. The transgenic animals used in such a study may express human HBM protein and LRP5 protein or the homologous HBM and LRP5 proteins defined for each species or variants thereof. Expression may be driven by a ubiquitous promoter or a bone specific promoter as would be known. It will be informative to compare groups of animals utilizing different promoters.

The transgenic animals of the method according to the present inventions may also comprise knock-in (KI) and/or knock-out (KO) animals, such as mice, which express HBM, LRP5, or neither under the control of the animal's native promoter. Such animals may be created by homologous recombination in ES cells as described above (and elsewhere in the literature of the art such as, for example, U.S. Pat. Nos. 6,187,991 and 6,187,992 and references cited therein which are incorporated herein in their entirety). The experimental groups of transgenic animals treated with candidate drugs may be monitored by non-invasive means, by the monitoring of surrogate markers as described above, and/or by ex vivo analysis of bones from sacrificed animals at given timepoints.

Likewise the effect of such treatments as dietary control (e.g. varying intake of vitamins, minerals, proteins, lipids, etc.), ovariectomy, direct administration of all or part of purified HBM or LRP5 proteins, administration of antisense nucleotides, antibodies against LRP5 or gene therapy in adults may be investigated by systematic administration of the treatment to transgenic animals according to the invention. Such treatments may include, administration of estrogens, tamoxifen, raloxifene, (or other selective estrogen modulators, SERMs), vitamin D analogs, calcitonin, cathepsin K inhibitors, statins (e.g. simvastatin, pravastatin, and lovastatin), bis-phosphonates, parathyroid hormone (PTH), bone morphogenetic proteins (BMP) as described in U.S. Pat. Nos. 6,190,880 and 5,866,364, and combinations of the above compounds.

Considering the observations that markers for cardiac health are modulated in HBM subjects together with the homology of LRP5 and LRP6 to the LDL receptor, it will be recognized that an aspect of the present invention is to use the novel research methods disclosed herein to screen known cardio-protective treatments for bone modulating effects. The animal models described herein can be used to test cardio-protective treatments for effects that replicate the HBM phenotype in whole or in part. Conversely, compounds and treatments that are identified as replicating or working synergistically with the HBM phenotype can be screened for cardio-protective effects using the models and methods describe herein. The models and methods are useful for testing drugs and researching lipid modulation functionalities arising from effects related LRP5 and HBM. Thereby, the present invention provides therapeutic methods which are both cardio-protective and which improve bone quality.

The effect of various mutations of LRP5 and HBM genes may be investigated by creation of additional lines of transgenic animals according to the invention, wherein these animals comprise such mutations. By comparison of direct measures of bone development or surrogate markers, an embodiment of the invention provides a useful research tool for screening gene therapy reagents, candidate drug therapies, and elucidating molecular mechanisms of bone development modulation. One skilled in the art knows how to use the methods of the present invention to achieve these goals.

The present invention provides a method and useful research tools for testing prospective gene therapies. Transgenic knock-out mice are useful for testing prospective gene therapies. As an example, a transgenic knock-out animal such as a mouse is created as described above which does not express endogenous LRP5 or HBM. A prospective gene therapy, such as intravenous injection of a recombinant replication-defective adenovirus encoding the human HBM protein driven by the CMVβActin promoter, is administered. Parameters of bone density and/or surrogate markers are monitored over time following therapy (Ishibashi et al., 1993 *J. Clin. Invest*. 92:883-93). A TaqMan® primer set such as that described above may be used to measure expression of transgenic HBM. One skilled in the art knows alternative methods such as the Northern blot method. Comparison of treated and untreated animals both within and between groups of germ-line transgenic animals, knock-out (null allele) background, and wild-type endogenous LRP5 background animals provides complementary controls for assessing the relative effectiveness of various modalities of gene therapy.

Uses for the transgenic animals models contemplated herein also include, but are not limited to: (1) sources for generating bone cell cultures from the calvaria of the transgenic animals to study bone cell (e.g., osteoblast and osteoclast) function and number; (2) models for studying the effects of estrogen loss by ovariectomiizing (ovx) the transgenic animals; (3) models for testing mechanical loading on the bones and other stress/strength tests; (4) breeding models with which to breed to other genetically modified or naturally occurring mutant animals that display bone abnormalities; (Chipman et al., *PNAS*, 90:1701-05 (1993); Phillips et al., *Bone*, 27:219-226 (2000); Kajkenova et al., *J. Bone Min. Res.*, 12:1772-79 (1997); Jilka et al., *J. Clin. Invest*. 97:1732-40 (1996); Takahashi et al., *Bone and Mineral*, 24:245-255 (1994); (5) bone use/disuse models to test the effects of weight bearing or gravity; (6) models for identifying and screening reagents which may or are known to modulate bone metabolism (e.g., PTH, estrogen, vitamin D analogs, bisphosphonates, statins, leptin, BMP, apoE, SERMS); (7) models for investigating prospective treatments to improve fracture repair. Transgenic animals may be cross bread with other genetic (or genetically modified) mouse models of bone disease, lipid disease, Wnt signaling, and the like. Examples of these: osteogenesis imperfecta (oi) mice, spontaneous fracture (sfx) mice, animals with abnormal ApoE, transgenic animals that monitor Wnt signaling with TCF-LacZ or some other reporter gene (GFP, luciferase, CAT), and the like.

The transgenic animal models can be analyzed using, but not limited to, such methods as bone densitometry by pDEXA, pQCT and microCT; histology, molecular marker analysis, apoptosis, cell proliferation, cell cycle, mineralization, serum biochemistry, transcriptional profiling, and the like.

XXII. Methods of Use: Avian and Mammalian Animal Husbandry

The LRP5 DNA and LRP5 protein and/or the HBM DNA and HBM protein can be used for vertebrate and preferably human therapeutic agents and for avian and mammalian veterinary agents, including for livestock breeding. Birds, including, for example, chickens, roosters, hens, turkeys, ostriches, ducks, pheasants and quails, can benefit from the identification of the gene and pathway for high bone mass. In many examples cited in literature (for example, McCoy et al., Res. Vet. Sci., 60(2): 185-186 (1996)), weakened bones due to husbandry conditions cause cage layer fatigue, osteoporosis and high mortality rates. Additional therapeutic agents to treat osteoporosis or other bone disorders in birds can have considerable beneficial effects on avian welfare and the economic conditions of the livestock industry, including, for example, meat and egg production.

XXIII. Methods of Use: Diagnostic Assays Using LRP5-specific Oligonucleotides for Detection of Genetic Alterations Affecting Bone Development In cases where an alteration or disease of bone development is suspected to involve an alteration of the LRP5 gene or the HBM gene, specific oligonucleotides may be constructed and used to assess the level of LRP5 mRNA or HBM mRNA, respectively, in bone tissue or in another tissue that affects bone development.

For example, to test whether a person has the HBM gene, which affects bone density, polymerase chain reaction can be used. Two oligonucleotides are synthesized by standard methods or are obtained from a commercial supplier of custom-made oligonucleotides. The length and base composition are determined by standard criteria using the Oligo 4.0 primer Picking program (Wojchich Rychlik, 1992) or any suitable alternative. One of the oligonucleotides is designed so that it will hybridize only to HBM DNA under the PCR conditions used. The other oligonucleotide is designed to hybridize a segment of LRP5 genomic DNA such that amplification of DNA using these oligonucleotide primers produces a conveniently identified DNA fragment. For example, the pair of primers CCAAGTTCTGAGAAGTCC (SEQ ID NO:32) and AATACCTGAAACCATACCTG (SEQ ID NO:33) will amplify a 530 base pair DNA fragment from a DNA sample when the following conditions are used: step 1 at 95° C. for 120 seconds; step 2 at 95° C. for 30 seconds; step 3 at 58° C. for 30 seconds; step 4 at 72° C. for 120 seconds; where steps 2-4 are repeated 35 times. Tissue samples may be obtained from hair follicles, whole blood, or the buccal cavity.

The fragment generated by the above procedure is sequenced by standard techniques. Individuals heterozygous for the HBM gene will show an equal amount of G and T at the second position in the codon for glycine 171. Normal or homozygous wild-type individuals will show only G at this position. Similar routine procedures may be used to develop assays for other polymorphisms and variants according to the invention.

Other amplification techniques besides PCR may be used as alternatives, such as ligation-mediated PCR or techniques involving Q-beta replicase (Cahill et al., Clin. Chem., 37(9): 1482-5 (1991)). For example, the oligonucleotides AGCTGCTCGTAGCTGTCTCTCCCTGGAT-CACGGGTACATGTACTGGACAG ACTGGGT (SEQ ID NO:34), and TGAGACGCCCCGGATTGAGCGGGCAGG-GATAGCTTATTCCCTGTGCCGCA TTACGGC (SEQ ID NO:35) can be hybridized to a denatured human DNA sample, treated with a DNA ligase, and then subjected to PCR amplification using the primer oligonucleotides AGCT-GCTCGTAGCTGTCT CTCCCTGGA (SEQ ID NO:36) and GCCGTAATGCGGCACAGGGAATAAGCT (SEQ ID NO:37). In the first two oligonucleotides, the outer 27 bases are random sequence corresponding to primer binding sites, and the inner 30 bases correspond to sequences in the LRP5 gene. The T at the end of the first oligonucleotide corresponds to the HBM gene. The first two oligonucleotides are ligated only when hybridized to human DNA carrying the HBM gene, which results in the formation of an amplifiable 114 bp DNA fragment.

Products of amplification can be detected by agarose gel electrophoresis, quantitative hybridization, or equivalent techniques for nucleic acid detection known to one skilled in the art of molecular biology (Sambrook et al., Molecular Cloning: A Laboratory Manual, Cold Spring Harbor Laboratory, Cold Spring, N.Y. (1989)).

Other alterations in the LRP5 gene or the HBM gene may be diagnosed by the same type of amplification-detection procedures, by using oligonucleotides designed to identify those alterations. These procedures can be used in animals as well as humans to identify alterations in LRP5 or HBM that affect bone development.

Expression of LRP5 or HBM in bone tissue may be accomplished by fusing the cDNA of LRP5 or HBM, respectively, to a bone-specific promoter in the context of a vector for genetically engineering vertebrate cells. DNA constructs are introduced into cells by packaging the DNA into virus capsids, by the use of cationic liposomes, electroporation, or by calcium phosphate transfection. Transfected cells, preferably osteoblasts, may be studied in culture or may be introduced into bone tissue in animals by direct injection into bone or by intravenous injection of osteoblasts, followed by incorporation into bone tissue (Ko et al., Cancer Research, 56(20): 4614-9 (1996)). For example, the osteocalcin promoter, which is specifically active in osteoblasts, may be used to direct transcription of the LRP5 gene or the HBM gene. Any of several vectors and transfection methods may be used, such as retroviral vectors, adenovirus vectors, or vectors that are maintained after transfection using cationic liposomes, or other methods and vectors described herein.

Alteration of the level of functional LRP5 protein or HBM protein affects the level of bone mineralization. By manipulating levels of functional LRP5 protein or HBM protein, it is possible to affect bone development and to increase or decrease levels of bone mineralization. For example, it may be useful to increase bone mineralization in patients with osteoporosis. Alternatively, it may be useful to decrease bone mineralization in patients with osteopetrosis or Paget's disease. Alteration of LRP5 levels or HBM levels can also be used as a research tool. Specifically, it is possible to identify proteins, mRNA and other molecules whose level or modification status is altered in response to changes in functional levels of LRP5 or HBM. The pathology and pathogenesis of bone disorders is known and described, for example, in Rubin and Farber (Eds.), Pathology, 2nd Ed., S.B. Lippincott Co., Philadelphia, Pa. (1994).

A variety of techniques can be used to alter the levels of functional LRP5 or HBM. For example, intravenous or intraosseous injection of the extracellular portion of LRP5 or mutations thereof, or HBM or mutations thereof, will alter the level of LRP5 activity or HBM activity, respectively, in the body of the treated human, animal or bird. Truncated versions of the LRP5 protein or HBM protein can also be injected to alter the levels of functional LRP5 protein or HBM protein, respectively. Certain forms of LRP5 or HBM enhance the activity of endogenous protein, while other forms are inhibitory.

In a preferred embodiment, the HBM protein is used to treat osteoporosis, fracture, or other bone disorder. In a further preferred embodiment, the extracellular portion of the HBM protein is used. This HBM protein may be optionally modified by the addition of a moiety that causes the protein to adhere to the surface of cells. The protein is prepared in a pharmaceutically acceptable solution and is administered by injection or another method that achieves acceptable pharmacokinetics and distribution.

In a second embodiment of this method, LRP5 or HBM levels are increased or decreased by gene therapy techniques. To increase LRP5 or HBM levels, osteoblasts or another useful cell type are genetically engineered to express high levels of LRP5 or HBM as described above. Alternatively, to decrease LRP5 or HBM levels, antisense constructs that specifically reduce the level of translatable LRP5 or HBM mRNA can be used. In general, a tissue-nonspecific promoter may be used, such as the CMV promoter or another commercially available promoter found in expression vectors (Wu et al., Toxicol. Appl. Pharmacol., 141(1):330-9 (1996)). In a preferred embodiment, a LRP5 cDNA or its antisense is transcribed by a bone-specific promoter, such as the osteocalcin or another promoter, to achieve specific expression in bone tissue. In this way, if a LRP5-expressing DNA construct or HBM-expressing construct is introduced into non-bone tissue, it will not be expressed.

In a third embodiment of this method, antibodies against LRP5 or HBM are used to inhibit its function. Such antibodies are identified herein.

In a fourth embodiment of this method, drugs that are agonists or antagonists of LRP5 function or HBM function are used. Such drugs are described herein and optimized according to techniques of medicinal chemistry well known to one skilled in the art of pharmaceutical development.

LRP5 and HBM interact with several proteins, such as ApoE. Molecules that inhibit the interaction between LRP5 or HBM and ApoE or another binding partner are expected to alter bone development and mineralization. Such inhibitors may be useful as drugs in the treatment of osteoporosis, osteopetrosis, or other diseases of bone mineralization. Such inhibitors may be low molecular weight compounds, proteins or other types of molecules. See, Kim et al., J. Biochem. (Tokyo), 124(6):1072-1076 (1998).

Inhibitors of the interaction between LRP5 or HBM and interacting proteins may be isolated by standard drug-screening techniques. For example, LRP5 protein, (or a fragment thereof) or HBM protein (or a fragment thereof) can be immobilized on a solid support such as the base of microtiter well. A second protein or protein fragment, such as ApoE is derivatized to aid in detection, for example with fluorescein. Iodine, or biotin, then added to the LRP5 or HBM in the presence of candidate compounds that may specifically inhibit this protein-protein domain of LRP5 or HBM, respectively, and thus avoid problems associated with its transmembrane segment. Drug screens of this type are well known to one skilled in the art of pharmaceutical development.

Because LRP5 and HBM are involved in bone development, proteins that bind to LRP5 and HBM are also expected to be involved in bone development. Such binding proteins can be identified by standard methods, such as co-immunoprecipitation, co-fractionation, or the two-hybrid screen (Ausubel et al., Current Protocols in Molecular Biology, John Wiley & Sons (1997)). For example, to identify LRP5-interacting proteins or HBM-interacting proteins using the two-hybrid system, the extracellular domain of LRP5 or HBM is fused to LexA and expressed for the yeast vector pEG202 (the "bait") and expressed in the yeast strain EGY48. The yeast strain is transformed with a "prey" library in the appropriate vector, which encodes a galactose-inducible transcription-activation sequence fused to candidate interacting proteins. The techniques for initially selecting and subsequently verifying interacting proteins by this method are well known to one skilled in the art of molecular biology (Ausubel et al., Current Protocols in Molecular Biology, John Wiley & Sons (1997)).

In a preferred embodiment, proteins that interact with HBM, but not LRP5, are identified using a variation of the above procedure (Xu et al., Proc. Natl. Acad. Sci. USA, 94(23):12473-8 (November 1997)). This variation of the two-hybrid system uses two baits, and LRP5 and HBM are each fused to LexA and TetR, respectively. Alternatively, proteins that interact with the HBM but not LRP5 may be isolated. These procedures are well known to one skilled in the art of molecular biology, and are a simple variation of standard two-hybrid procedures.

As an alternative method of isolating substances interacting with LRP5 or HBM, a biochemical approach is used. The LRP5 protein or a fragment thereof, such as the extracellular domain, or the HBM protein or a fragment thereof, such as the extracellular domain, is chemically coupled to Sepharose beads. The LRP5- or HBM-coupled beads are poured into a column. A biological extract, such as a lipid fraction, serum proteins, proteins in the supernatant of a bone biopsy, or cellular contents from gently lysed osteoblast cells, is added to the column. Non-specifically bound compounds are eluted, the column is washed several times with a low-salt buffer, and then tightly binding compounds may be eluted with a high-salt buffer. These are candidate compounds that bind to LRP5 or HBM, and can be tested for specific binding by standard tests and control experiments. Sepharose beads used for coupling proteins and the methods for performing the coupling are commercially available (Sigma), and the procedures described here are well known to one skilled in the art of protein biochemistry.

As a variation of the above procedure, proteins that are eluted by high salt from the LRP5- or HBM-sepharose column are then added to an HBM-LRP5-sepharose column. Proteins that flow through without sticking are proteins that bind to LRP5 but not to HBM. Alternatively, proteins that bind to the HBM protein and not to the LRP5 protein can be isolated by reversing the order in which the columns are used.

Isolated compounds may be identified by standard methods such as 2D gel electrophoresis, chromatography, and mass spectroscopy.

XXIV. Method of Use: Transformation-Associated Recombination (TAR) Cloning

Essential for the identification of novel allelic variants of LRP5 is the ability to examine the sequence of both copies of the gene in an individual. To accomplish this, two "hooks," or regions of significant similarity, are identified within the genomic sequence such that they flank the portion of DNA that is to be cloned. Most preferably, the first of these hooks is derived from sequences 5' to the first exon of interest and the second is derived from sequences 3' to the last exon of interest. These two "hooks" are cloned into a bacterial/yeast shuttle vector such as that described by Larionov et al., Proc. Natl. Acad. Sci. USA, 94:7384-7387 (1997). Other similar vector systems may also be used. To recover the entire genomic copy of the LRP5 gene, the plasmid containing the two "hooks" is linearized with a restriction endonuclease or is produced by another method such as PCR. This linear DNA fragment is introduced into yeast cells along with human genomic DNA. Typically, the yeast Saccharomyces cerevisiae is used as a host cell, although Kouprina et al. (Genome Res., 8:666-72, 1998) have reported using chicken host cells as well. During and after the process of transformation, the endogenous host cell converts the linear plasmid to a circle by a recombination event whereby the region of the human genomic DNA homologous to the "hooks" is inserted into the plasmid. This plasmid can be recovered and analyzed by methods well known to one skilled in the art. Obviously, the specificity for this reaction requires the host cell machinery to recognize sequences similar to the "hooks" present in the linear fragment. However, 100% sequence identity is not required, as shown by Kouprina et al., *Genomics*, 53(1):21-28 (October 1998), where the author describes using degenerate repeated sequences common in the human genome to recover fragments of human DNA from a rodent/human hybrid cell line.

In another example, only one "hook" is required, as described by Larionov et al., *Proc. Natl. Acad. Sci. USA*, 95(8):4469-74 (April 1998). For this type of experiment, termed "radial TAR cloning," the other region of sequence similarity to drive the recombination is derived from a repeated sequence from the genome. In this way, regions of DNA adjacent to the LRP5 gene coding region can be recovered and examined for alterations that may affect function.

XXV. Methods of Use: Genomic Screening

The use of polymorphic genetic markers linked to the HBM gene or to LRP5 is very useful in predicting susceptibility to osteoporosis or other bone diseases. Koller et al., *Amer. J. Bone Min. Res.*, 13:1903-1908 (1998) have demonstrated that the use of polymorphic genetic markers is useful for linkage analysis. Similarly, the identification of polymorphic genetic markers within the high bone mass gene will allow the identification of specific allelic variants that are in linkage disequilibrium with other genetic lesions that affect bone development. Using the DNA sequence from the BACs, a dinucleotide CAn repeat was identified and two unique PCR primers that will amplify the genomic DNA containing this repeat were designed, as shown below:

```
B200E21C16_L:  GAGAGGCTATATCCCTGGGC    (SEQ ID NO:38)

B200E21C16_R:  ACAGCACGTGTTTAAAGGGG    (SEQ ID NO:39)
``` and used in the genetic mapping study.

This method has been used successfully by others skilled in the art (e.g., Sheffield et al., *Genet.*, 4:1837-1844 (1995); LeBlanc-Straceski et al., *Genomics*, 19:341-9 (1994); Chen et al., *Genomics*, 25:1-8 (1995)). Use of these reagents with populations or individuals will predict their risk for osteoporosis. Similarly, single nucleotide polymorphisms (SNPs), such as those shown in Table 4 above, can be used as well to predict risk for developing bone diseases or resistance to osteoporosis in the case of the HBM gene.

XXVI. Methods of Use: Modulators of Tissue Calcification

The calcification of tissues in the human body is well documented. Towler et al., *J. Biol. Chem.*, 273:30427-34 (1998) demonstrated that several proteins known to regulate calcification of the developing skull in a model system are expressed in calcified aorta. The expression of Msx2, a gene transcribed in osteoprogenitor cells, in calcified vascular tissue indicates that genes which are important in bone development are involved in calcification of other tissues. Treatment with HBM protein, agonists or antagonists is likely to ameliorate calcification (such as the vasculature, dentin and bone of the skull visera) due to its demonstrated effect on bone mineral density. In experimental systems where tissue calcification is demonstrated, the over-expression or repression of LRP5 activity permits the identification of molecules that are directly regulated by the LRP5 gene. These genes are potential targets for therapeutics aimed at modulating tissue calcification. For example, an animal, such as the LDLR −/−, mouse is fed a high fat diet and is observed to demonstrate expression of markers of tissue calcification, including LRP5. These animals are then treated with antibodies to LRP5 or HBM protein, antisense oligonucleotides directed against LRP5 or HBM cDNA, or with compounds known to bind the LRP5 or HBM protein or its binding partner or ligand. RNA or proteins are extracted from the vascular tissue and the relative expression levels of the genes expressed in the tissue are determined by methods well known in the art. Genes that are regulated in the tissue are potential therapeutic targets for pharmaceutical development as modulators of tissue calcification.

The nucleic acids, proteins, peptides, amino acids, small molecules or other pharmaceutically useful compounds of the present invention that are to be given to an individual may be administered in the form of a composition with a pharmaceutically acceptable carrier, excipient or diluent, which are well known in the art. The individual may be a mammal or a bird, preferably a human, a rat, a mouse or bird. Such compositions may be administered to an individual in a pharmaceutically effective amount. The amount administered will vary depending on the condition being treated and the patient being treated. The compositions may be administered alone or in combination with other treatments.

Although the invention has been set forth in detail, one skilled in the art will recognize that numerous changes and modifications can be made, and that such changes and modifications may be made without departing from the spirit and scope of the invention.

The patents, patent applications and publications cited in the specification are hereby incorporated by reference herein in their entirety for all purposes. Further, U.S. application Ser. Nos. 09/543,771 and 09/544,398 filed on Apr. 5, 2000, application Ser. No. 09/229,319, filed Jan. 13, 1999, U.S. Provisional Application No. 60/071,449, filed Jan. 13, 1998, and U.S. Provisional Application No. 60/105,511, filed Oct. 23, 1998, are herein incorporated by reference in their entirety for all purposes.

EXAMPLES

The present invention is described by reference to the following Examples, which are offered by way of illustration and are not intended to limit the invention in any manner. Standard techniques well known in the art or the techniques specifically described below were utilized.

Example 1

The propositus was referred by her physicians to the Creighton Osteoporosis Center for evaluation of what appeared to be unusually dense bones. She was 18 years old and came to medical attention two years previous because of back pain, which was precipitated by an auto accident in which the car in which she was riding as a passenger was struck from behind. Her only injury was soft tissue injury to her lower back that was manifested by pain and muscle tenderness. There was no evidence of fracture or subluxation on radiographs. The pain lasted for two years, although she was able to attend school full time. By the time she was seen in the Center, the pain was nearly resolved and she was back to her usual activities as a high school student. Physical exam revealed a normal healthy young woman standing 66 inches and weighing 128 pounds. Radiographs of the entire skeleton revealed dense looking bones with thick cortices. All bones of the skeleton were involved. Most importantly, the shapes of all the bones were entirely normal. The spinal BMC was 94.48 grams in L1-4, and the spinal BMD was 1.667 gm/cm$^2$ in L1-4. BMD was 5.62 standard deviations (SD) above peak skeletal mass for women. These were measured by DXA using a Hologic 2000~. Her mother was then scanned and a lumbar spinal BMC of 58.05 grams and BMD of 1.500 gm/cm$^2$ were found. Her mother's values place her 4.12 SD above peak mass and 4.98 SD above her peers. Her mother was 51 years old, stood 65 inches and weighed 140 pounds. Her mother was in excellent health with no history of musculoskeletal or other symptoms. Her father's lumbar BMC was 75.33 grams and his BMD was 1.118 gm/cm$^2$. These values place him 0.25 SD above peak bone mass for males. He was in good health, stood 72 inches tall, and weighed 187 pounds.

These clinical data suggested that the propositus inherited a trait from her mother, which resulted in very high bone mass, but an otherwise normal skeleton, and attention was focused on the maternal kindred. In U.S. Pat. No. 5,691,153, twenty-two of these members had measurement of bone mass by DXA. In one case, the maternal grandfather of the propositus, was deceased, however, medical records, antemortem skeletal radiographs and a gall bladder specimen embedded in paraffin for DNA genotyping were obtained. His radiographs showed obvious extreme density of all of the bones available for examination including the femur and the spine, and he was included among the affected members. In this invention, the pedigree has been expanded to include 37 informative individuals. These additions are a significant improvement over the original kinship (Johnson et al., *Am. J. Hum. Genet.*, 60:1326-1332 (1997)) because, among the fourteen individuals added since the original study, two individuals harbor key crossovers. X-linkage is ruled out by the presence of male-to-male transmission from individual 12 to 14 and 15.

Example 2

The present invention describes DNA sequences derived from two BAC clones from the HBM gene region, as evident in Table 8 below, which is an assembly of these clones. Clone b200e21-h (ATCC No. 98628; SEQ ID NOS: 10-11) was deposited at the American Type Culture Collection (ATCC), 10801 University Blvd., Manassas, Va. 20110-2209 U.S.A., on Dec. 30, 1997. Clone b527d12-h (ATCC No. 98907; SEQ ID NOS: 5-9) was deposited at the American Type Culture Collection (ATCC), 10801 University Blvd., Manassas, Va. 20110-2209 U.S.A., on Oct. 2, 1998. These sequences are unique reagents that can be used by one skilled in the art to identify DNA probes for the LRP5 gene, PCR primers to amplify the gene, nucleotide polymorphisms in the LRP5 gene, or regulatory elements of the LRP5 gene.

TABLE 8

| Contig | ATCC No. | SEQ ID NO. | Length (base pairs) |
| --- | --- | --- | --- |
| b527d12-h_contig302G | 980720 | 5 | 3096 |
| b527d12-h_contig306G | 980720 | 6 | 26928 |
| b527d12-h_contig307G | 980720 | 7 | 29430 |
| b527d12-h_contig308G | 980720 | 8 | 33769 |
| b527d12-h_contig309G | 980720 | 9 | 72049 |
| b200e21-h_contig1 | 980812 | 10 | 8705 |
| b200e21-h_contig4 | 980812 | 11 | 66933 |

Example 3

Methods of Using Explant Cultures from HBM Overexpressing Transgenic and Non-transgenic Mice.

The use of transgenic animals of the invention for the identification of surrogate markers for the HBM phenotype and putative targets for bone mass modulation therapies and drugs by the methods of the invention and the identification and characterization of genes related to HBM through transcriptional profiling is demonstrated, for example, in calvaria and tibia explant cultures.

Calvaria and tibia were obtained from neonatal (12-day-old) mice, including transgenic mice expressing HBM under the bone specific type I collagen promoter (Line 19). Calvaria were pooled from 4 transgenic and 4 non-transgenic mice and digested with collegenase. The digests were plated in culture. Calvaria cultures were maintained with or without ascorbic acid and beta glycerol phosphate for 19 days. RNA was isolated at day 19.

Bone marrow stromal cells were flushed out of tibia and the tibias from individual animals were then subjected to two consecutive collagenase digests. Following collagenase digestion the bone chips were plated in culture and three consecutive seedings were obtained. Cells from seeding 3 were much slower growing than those from seedings 1 and 2. RNA was isolated from confluent cells of seedings 1 through 3 (passage 1). RNA from both calvaria and tibia cultures were analyzed on U74Av2 transcriptional profiling arrays.

Treatment with ascorbic acid and beta glycerol phosphate resulted in the set of genes differentially expressed being quite different. Alkaline phosphatase (AKP) gene expression increased following treatment indicating differentiation of the treated cells. The data obtained from treated cells was of different quality than that obtained from untreated cells, and there was also variation in gene expression between the culture replicates.

The transcriptional profile from non-transgenic and transgenic mice showed differences in the expression of several relevant genes, for example, S100A1, MMP9, and MT1.

There is mouse-to-mouse variability in the transcriptional profile of tibia explant cultures from the 4 mice in each group (i.e., non-transgenic and HBM transgenic). This variation can still be seen following normalization. However, the variability does not affect the interpretation of the data to any significant extent. Variability is also seen in measurements of alkaline phosphatase activity in these cells.

The results may be summarized as follows: Seeding 1 and seeding 2 were similar (and different from seeding 3) in their transcriptional profiles. This is likely be due to differences in growth characteristics of these cells. Seeding 1 also shows greater differences between transgenic and non-transgenic profiles, probably because it is a relatively more mixed population of cells than either seeding 2 or 3.

Several of the differences in gene expression between the non-transgenic and HBM transgenic mice are consistent with differences seen between the affected and unaffected individuals from the human HBM1 kindred. As one example, S100A1 (GenBank #AF087687) is upregulated in transgenic osteoblast cultures. The protein encoded by this gene is a member of the S100 family of proteins containing 2 EF-hand calcium-binding motifs. S100 proteins are localized in the cytoplasm and/or nucleus of a wide range of cells, and involved in the regulation of a number of cellular processes such as cell cycle progression and differentiation. Matrix metalloproteinase 9 (MMP9) (GenBank #X72794) is also upregulated in transgenic osteoblast cultures. Proteins of the matrix metalloproteinase (MMP) family are involved in the breakdown of extracellular matrix in normal physiological processes, such as embryonic development, reproduction, and tissue remodeling, as well as in disease processes, such as arthritis and metastasis. Most MMP's are secreted as inactive proproteins which are activated when cleaved by extracellular proteinases. The enzyme encoded by this gene degrades type IV and V collagens.

Among genes downregulated in HBM transgenic osteoblast cultures is metallothionein 1 (MT1) (GenBank #S62785) a cysteine-rich, metal-binding protein that has been shown to play an important role as antioxidant. Its activity mediates cytotoxicity from inflammatory processes. It is expressed in both bone and cartilage.

Additional genes that are differentially expressed in transgenic bone tissue can be determined by one of skill in the art using the methods herein described. From the transcriptional profiling data, it can be seen that the profile of transgenic mouse tibia resembles that of the affected members of the human HBM kindred in several ways.

Profiles of differentially expressed genes identified as above can be used as markers in a method of identifying an HBM mimetic compound or treatment. Thus, explant cultures of cells of transgenic and non-transgenic animals can be used in a method wherein such cell cultures are exposed to one or more compounds or experimental procedures and the resulting transcriptional profile can be compared to expression profile of control cells and/or explant cell cultures from transgenic animals in which LRP5 and/or HBM and/or LRP6 activity or expression has been modified. Compounds that cause specific HBM-like transcriptional profile changes are thus identified as HBM mimetic compounds and can be therapeutically effective compounds.

Example 4

Methods of Using Transgenic Mice to Study Loading Response in the Context of the HBM Phenotype Effects of transgenic modifications, such as LRP5, LRP6, and HBM expression, over-expression or knock-out, on bone development and can be assessed using a loading or unloading protocol. Bone growth rates subject to loading or unloading, gene expression response profiling, and biomechanical parameters of the HBM phenotype can be further characterized by these methods. These methods of using transgenic animals of the invention are valuable tools in the development of treatments and drugs which recapitulate desired characteristics of the HBM phenotype.

Mechanical loads are delivered to the tibiae of transgenic or non-transgenic mice with the four-point bending device. The device is calibrated for accurate, in vivo, external force application. The device applies force through four rounded pads composed of balsa wood and covered by 1 mm thick surgical tubing. The upper pads are 4.5 mm apart and centered between the lower pads that are 12 mm apart. With four-point bending, a constant bending moment is delivered throughout the bone tissue between the two inner pads with the lateral side of the tibia in compression and the medial in tension. An illustration of the device is seen in FIG. 28. The upper distal pad contacts the leg 1 mm proximal to the tibia-fibular junction (TFJ) and the lower distal pad contacts the medial surface at 2.5 mm distal to the TFJ. The region of maximal bending is from 1-6 mm proximal to the TFJ or 8.5 to 13.5 mm from distal end. This region has been radiographically defined. The loading device is calibrated before each experiment, and loads are recorded for each animal daily. The machine is zeroed and adjusted if there is any drift in the load. Leg positioning and applied loads are consistent between animals and days with less than 10% variation in strain due to leg positioning and less than 1.6% variation in loads (Hagino et al., *J. Bone Miner. Res.* 8:347-57, 1993).

Mechanical loads are applied to the right lower leg while the mouse is under light isoflurane anesthesia (2%). Reliable leg positioning will be attained by standard positioning of the mouse on a platform, placing the right foot in a stirrup, and aligning the knee with the loading device. The isoflurane is short acting so it prevents movement during loading, but normal weight bearing activity returns within seconds after loading. Activity is monitored for proper recovery from the isoflurane and that no injury to the leg has occurred. De-loading may be accomplished by unilateral neurectomy (Kodama et al., *Bone*, 25:183-90, 1999). In addition, a strain gauge may be applied to the tibia in vivo during the application of four point load.

Fluorochrome labels: All mice to be studied for histomorphometry receive a double calcein label administered 10 and 3 days before tissue collection. Mice on the longterm loading study receive a baseline injection of tetracycline before loading in addition to the final double calcein injection. These injections are prepared in a dilution suitable for injection at 1 ml/kg. The volume of injection for a 25 g mouse would be 0.025 ml. All injections are subcutaneous and given under mild sedation (isoflurane 2%).

Calcein labels-(Sigma, St. Louis, Mo.) is injected at 6.2 mg/kg. Two calcein labels are administered on two different days, i.e. 3 and 10 days, before autopsy. This fluorochrome label is used to identify mineralizing surfaces in undecalcified tissue and quantify the rate of bone formation during the final week of the treatment. The label is not used for BrdU or in situ hybridization studies that examine decalcified bone.

Tetracycline- (Pfizer, CT) is injected at 25 mg/kg. A single tetracycline label is administered on Day 0 to all animals in long term studies (greater than 5 weeks) This fluorochrome label marks the mineralizing surface at the start of the study and allows quantification of total bone formation during the experiment.

BrDU-(bromodeoxyuridine, Boehringer Mannheim): is injected at 40mg/kg and the vehicle is bacteriostat. Mice are given 5 injections at 6 hr intervals to label DNA synthesis over a 24 hr period. The last injection is one hour before tissue collection.

Death is induced by CO inhalation, except when animals are perfused with fixative. The right and left tibia are excised for all loading and disuse studies. The right leg is the loaded or treated leg and the left the treated control. Tissue is collected from the loaded region of the right tibia and from a similar region on the left tibia. For mice, we have determined the average loaded region to be from 1 to 6 mm proximal to the tibial fibula junction (TFJ).

Undecalcified Cortical Bone Samples: Tibia, femur, and vertebra are collected for standard histomorphometry of undecalcified bone sections. The majority of the muscle is removed and the bone placed in 70% EtOH for 48 hours. The bones are cut with a saw to create the following samples for analysis a) tibial shaft including the TFJ, b) the distal femur, and c) vertebral body free of the disks. The tibial diaphysis is placed in Villanueva stain for 72 hrs and then returned to 80% ethanol. All other bones move directly into dehydration. During the next 14 days, the specimens are dehydrated in graded ethanols and acetone, then embedded individually in modified methyl methacrylate. The embedded tibial cortical samples are cross-sectioned at 70 μm on a saw-microtome (Model 1600, Leica, Germany) with sections collected from the region. Sections are taken from the loaded region to produce a section 5-7 mm proximal to the TFJ in rats and 9-13 mm from the distal end with a 0.8 mm inter-section distance. Two sections from each tibia will be mounted, given a random number, and analyzed.

Decalcified Cortical Bone Samples: The animal tissue is perfused with 4% paraformaldehyde until the soft tissue in the leg is rigid. The tibiae is excised and muscle trimmed with scissors while the bone is submerged in cold 4% paraformaldehyde. The periosteum and a small muscle layer are left intact. For in situ hybridization studies all work is done with RNAse free materials. A 4-5 mm section from the loaded region of the tibia is excised from the intact tibia with a saw and fixed in 4% paraformaldehyde at 4° C. for 24 hours. After fixation the bones are decalcified in 7%EDTA (Sigma) at a pH of 6.5 for 2-3 weeks. The bones are then placed in 1% MgCl for 6 hours to restore alkaline phosphatase activity. The diaphyseal segment is embedded in JB-4 plus (Polyscience) or paraffin. Cross sections are cut on a microtome (Reichert Jung) at 5 μm thickness using a tungsten carbide knife. The sections are mounted on poly l-lysine (Sigma) or coated slides.

As seen in FIG. 29, calcein staining of mice subjected to loading shows greater growth in heterozygous HBM transgenic mice (Line 19) than in non-transgenic control mice. A single strain (5N or 7N, 36 cycles at 2 Hz) was administered for 5 days. Calcein labeling occurred on days 5 and 12 with tissues harvested on day 15.

Example 5

Methods of Using Transgenic Animals to Study Interactions Between Factors of Bone Mass Modulation in the Context of the HBM Phenotype Transgenic mice expressing LRP5 with the G171V mutation have the HBM phenotype. Nine week old male transgenic (het) mice have significantly (p<0.001) higher total and trabecular bone mineral density (BMD) (570±7, 357±4 mg/cm$^3$, respectively) than their non-transgenic littermates (ntg) (360±13, 147±4 mg/cm$^3$, respectively). Such a transgenic animal model of the HBM phenotype can be used to study the effect of a surgical procedure or treatment on bone mass. These methods are useful for evaluating procedures and treatments as candidate HBM mimetics or for the effect of enhancing or inhibiting the HBM phenotype.

To study potential differences in bone mass changes caused by differences in mechanosensory regulation produced by the mutation, the skeletal response of transgenic mice to unloading was evaluated and contrasted with loading-independent effects of ovariectomy (ovx).

To examine the effects of unloading, unilateral sciatic neurectomy was performed on the right limb of het and ntg male mice and femoral BMD measurements were taken after one and two weeks. Bone loss was evaluated as the difference in BMD between the neurectomized (i.e., denervated) right femur and that of unoperated left femur and are expressed as a percent.

At both time points, in both het and ntg mice, total and trabecular BMD were significantly decreased in the distal femur of the denervated limb compared to that for the contralateral intact limb. However, at both time points, the rate of bone loss due to unloading was greater for ntg than for het.

After 2 weeks, the denervation-induced decrease in total and trabecular density in ntg mice (16.3±1.6% and 19.7±2.2%, respectively) was significantly (p<0.05) greater than for the het mice (10.0±1.4% and 11.5±2.5%, respectively).

| Percentage Decrease in Bone Mass Density After 2 Weeks of Limb Disuse | | | |
|---|---|---|---|
| total | | trabecular | |
| transgenic | non-transgenic | transgenic | non-transgenic |
| 10.0 ± 1.4 | 16.3 ± 1.6 | 11.5 ± 2.5 | 19.7 ± 2.2 |

To determine whether the mutation had any effect on ovx-induced osteopenia, het and ntg mice were ovariectomized at 9 weeks of age and treated for 35 days with vehicle or 10 μg/kg/day 17β-estradiol (E2). The percent change in total, trabecular and cortical density in het and ntg ovx mice from those values in their respective sham operated controls were determined. Ovariectomy resulted in significant bone loss in both het and ntg ovx groups compared to their respective sham-ovx controls and the rate of this bone loss was comparable for both groups.

Ovariectomy induced a 14.3% decrease in total BMD (696±6 to 597±7 mg/cm$^3$) and a 26.3% decrease in trabecular BMD (445±9 to 328±7 mg/cm$^3$) in the het group and a 14.9% decrease in total BMD (470±10 to 400±7 mg/cm$^3$) and 37.6% decrease in trabecular BMD (132±4 to 82±2 mg/cm$^3$) in the ntg group. Treatment with E2 completely prevented the ovx-induced bone loss in both het and ntg.

| Percentage Decrease in Bone Mass in OVX Mice | | | |
|---|---|---|---|
| total | | trabecular | |
| transgenic | non-transgenic | transgenic | non-transgenic |
| 14.3 | 14.9 | 26.3 | 37.6 |

In conclusion, the LRP5 G171V mutation does not substantially alter the rate of ovx-induced total bone loss and responsiveness to E2, but it can reduce bone loss due to unloading disuse. The results indicate that therapeutics which produce the HBM phenotype, genetically or by modulating LRP5, may be further enhanced in post-menopausal women when co-administered with anti-resorptive agents such as estrogens, SERMs and bisphosphonates. Transgenic animal model methods can be used to evaluate these interactions.

Example 6

LRP6 Transgenic Animal Model of the HBM Phenotype

LRP6 is a closely related homologue of LRP5, and like LRP5 has been identified as a co-receptor in the Wnt signaling pathway. Embryos homozygous for an inactivating mutation in LRP6 die at birth and exhibit a variety of severe developmental abnormalities including truncation of the axial skeleton, limb defects, microophthalmia and malformation of the urogenital system. Unlike the LRP6 mutants, mice homozygous for LRP5 disruption are viable but develop a low bone mass phenotype and retain embryonic eye vascularization. Clinically, inactivating mutations of LRP5 result in a severe reduction in bone mass and ocular pathology but, interestingly, heterozygous carriers of these mutations can have an intermediate low bone mass phenotype. To investigate dosage effects of LRP6 on skeletal development, a transgenic animal model can be used.

A heterozygous LRP6 transgenic mouse was obtained as follows. Chimeric mice were generated with ES cells, identified as OST38808, by injection into C57BL/6 albino host blastocyts, which were then transferred to pseudopregnant females and allowed to develop through birth. Germline chimeras were backcrossed to 129SvEVBrd strain mice to maintain the knockout allele of LRP6 on an inbred 129S8SvEvBrd genetic background. Germline transmission of the LRP6-KO allele was identified by PCR amplification of a gene trap specific sequence. Heterozygous LRP6-KO mating pairs were used for continued breeding. The genotype of wt and LRP6 +/− progeny was determined by tail DNA PCR.

We evaluated bone density of the femur of LRP6 +/− males and females at 9, 17 and 26 weeks of age. The distal femurs of female LRP6 +/− mice at all ages had 9.5% to 12% lower total bone mineral density (BMD) and 20 to 31% lower trabecular BMD than age-matched wild-type (wt) mice. At 9, 17 and 26 weeks of age, total BMD values of the femur as measured by pQCT for female LRP6 +/− mice were significantly lower (p<0.05) than total BMD of femur for wt. Trabecular BMD of the femur in female LRP6 +/− mice was significantly lower (p<0.01) than the trabecular BMD for the age-matched wt groups. MicroCT analysis of the distal femurs revealed that at all time points BV/TV, connectivity density and trabecular number were significantly lower and trabecular separation was significantly higher in LRP6 +/− mice compared to the corresponding wt group.

In male LRP6 +/− mice, the values for total BMD and for trabecular density were 3.5-7% and 8-27% lower, respectively, than those for the corresponding age-matched WT groups. Total and trabecular BMD in male LRP6 +/− mice were lower than corresponding wt groups; however, statistically significant differences between LRP6 +/− and wt mice were observed only in trabecular BMD at 17 weeks (p<0.05) and at 26 weeks (p<0.05).

and to assess the specificity of responses to compounds that mimic the HBM phenotype in normal animals.

Example 7

Use of a HBM Transgenic Mouse Model to Study Effects of Modulators of Bone Density and Development in the Context of the HBM Phenotype.

Nine week old LRP5 G171V transgenic (het) and non-transgenic littermate (ntg) male mice were treated with human parathyroid hormone (hPTH) (100 mg/kg/day, sc) or vehicle for 30 days. Total, trabecular and cortical densities were measured in excised left femur by pQCT. PTH response was normalized to the bone densities of the vehicle group and expressed as percent change from their respective vehicle controls.

Both het and ntg responded to treatment with PTH with a significant increase in total femoral BMD. This increase appeared to be primarily due to an increase in the trabecular bone compartment in the het animals and to a significant increase in cortical bone in the ntg animals, which showed no changes in trabecular BMD.

Thus, the transgenic mouse model can be used to identify agents that can be advantageously co-administered with treatments developed to mimic the G171V mutation and result in

| | Bone Density in Male Mice ($mg/cm^3$) | | | Bone Density in Female Mice ($mg/cm^3$) | | | |
|---|---|---|---|---|---|---|---|
| | trabecular | | | total | | trabecular | |
| | LRP6 +/− | wt | | LRP6 +/− | wt | LRP6 +/− | wt |
| | | | 9 weeks | 475 ± 12 | 539 ± 16 | 113 ± 7 | 163 ± 13 |
| 17 weeks | 128 ± 10 | 175 ± 9 | 17 weeks | 488 ± 13 | 611 ± 9 | 128 ± 8 | 175 ± 6 |
| 26 weeks | 162 ± 8 | 220 ± 18 | 26 weeks | 552 ± 17 | 619 ± 11 | 152 ± 8 | 191 ± 7 |

These results indicate that (1) mice heterozygous for a defective LRP6 gene have lower BMD than wild-type and (2) the magnitude of this difference is more pronounced in females than in males. The heterozygous LRP6 transgenic mouse model can be used to study procedures and treatments that modulate HBM like phenotypic effects.

Further, by breeding LRP6 heterozygous knock out animals with transgenic LRP5 over expressing animals, the interaction between LRP5 mediated effects and LRP6 mediated effects can be determined. Conversely, an LRP6 expressing animal can be bread with a LRP5 knockout animal. These model systems can be useful in methods to identify or refine a HBM mimetic compound. For example, such animals can be used in methods as disclosed herein, where the results can be further interpreted to assess the potential for genetic rescue enhanced efficacy. Further, these results indicate that anabolic agents such as PTH are candidate agents for synergistic effects.

| | Percent Change in Bone Mass Density After 30 Days of hPTH Treatment | | | | | |
|---|---|---|---|---|---|---|
| | total | | trabecular | | cortical | |
| | transgenic | ntg | transgenic | ntg | transgenic | ntg |
| Male | 37 | 23 | 80 | 5 | 2 | 3 |
| Female | 30 | 18 | 59 | −3 | −1 | 4 |

SEQUENCE LISTING (812 sequences)

SEQ ID NO: 1 - DNA, 5120 bp, Homo sapiens
actaaagcgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggtggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaaca

SEQ ID NO: 2 - DNA, 5120 bp, Homo sapiens
actaaagcgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactgggttgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggtggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaaca

SEQ ID NO: 3 - protein, 1615 aa, Homo sapiens
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPKAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGWSHLCLLSPSEPFYTCACPTGVQMQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKNISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEVDCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 4 - protein, 1615 aa, Homo sapiens
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPKAIALDPAHGYMYWTDWVETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGWSHLCLLSPSEPFYTCACPTGVQMQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKNISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEVDCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 5 - DNA, 3096 bp, Homo sapiens
catcttctcacacgatctctcgcttcgcactccttcctttgattggttttcaccatttactcagacgacggtccttcttcgatctttgcacattcttctatcatctactaccttcatacccagctccgtcccctaatattcatgcgcggatggcccattccgtggtgaaaattcccttctactctgctaatctgctgttctctctccctcccgtcgggttctgctcctgccacgttctcccctctccccaccaaaggctgggttttctttgtcagggctcctttcccctttggaagaaggggggctgtatggccttggtgcgaggccctccagtgacaggatcccccatcacccagagttccacaggccctggtagggaggagggggagcagaagaggaggtgccatctttgcctgctggggaagggcaggggccacccacacagagctctcccatttgctgtggaccctggggccactgcccagttccttccaaaggaaagccagctccccaggtggtgggagagtgatatggcttcctcttaaacttagggaattgagtgtgtggttgcttctaagtgccttagaagccgggagcggctcctggaaagagcctgcctgccacagcgggccttaccctggctgtgcccacagatgtccctggggcctgccgctcctgcccggctctcctggcctcccccggtgtgggttgggaaaagcacagcaaattaaaaaacacctccatctctggcctttgaagaatgcatctgaacagccgagagtgtaaaccgtggtgaaatgtggtctttccagtttggggagaagcagggcagagctggggcttttgtacccagggtttccaagagctcctgcctccctcggctgggctggccagggccccccgctgggacctccagctgtaatagggaaggttttactgggttgctggccactgtggactgcccctaagggcaggtatgcctgcctttacccgggttcccctcctgcctggaagatacagcccatgggaggcctgttgtctgtgggatcctccagcatcagagacactggggccagcgtctgcctggtgaggtgcaggcctggcaggcccggtcccccacctgcttgagcacccacggtggtgggggctcgctgcctcccgagacaatctatgtcattgttgtccaaggaagctaatttagagtagaaagttccgtgtccagtcccactctgtgcgtgtgttagcaggggactctcgggccggagctgggtccaccctggtagggggacttcatggggcctgggcgacagcactgtgtatttgtgtgtgtgtgtgtttgtgtgtgtgtgtgtctgaggaggtggaccagtttctcaaaaggcctgtgaccccaagaaccaaggaatttcagcctgggtggatcacaccttcactggtgagtgggacaagctgggggccctcgccacaggagcagccagggcatggggcacagttggcctcattcacaaaatgggagtataagtgatccctgctctggcggccaggacgatgagtgggaacacaccgtgtgggggctgcctggcctgggtgtgccgcgggtgtccttgttggtgatggttccacctgcttgtgccaccagtgccctctgggtctcacacacaactctcttcccagcgaaggcccctcctgccctcaggcctcagtgctgcttccgtctcggaaggccccaggagctcctgcatcctgggcgtgattcctgtgtgcctgcagaccccctcgcggctgccatctcatcctttggtgcacctgttggccagacctcctggtagcgggtgctgcactcccctgaatgtgccggggcctgggggcagggacctgggctcctccctcactgagtggagggaactcagtgtcttggagttggggtgcctgcaggctgggtggtgcaggtgaaatgcagacctctcagctggtgttccagagcagctgccttcccccgcccgagggacttcacccgcagcccagtcaggggtggcgcctgggtgcatcgcccgcaggctgggtaggggtggagcctgggtggccctgcctgtgagctgcatagttgtcgcctttgaccctgagttttcttcgttatctgtttggacctgtttggggcaggcaggggatgagatctgaagataaatgccttagctgtgaccatctccttttgtgagaggtcaatgtccagttccgctgcagttataacatcccattttttgatttctttttattttttcctttttctttttgagatggagtctcgctctgtcacccaggctggagtgcaatggggtgacctcagctcactgcaacctccacttctcgggttcaagtgattctcctgcctcagcctcctgactagcaggggttacaggcgtgagccaccacgcccagctaatttttgtatttttagtagaggcaaggtttcgtcatgttggccaggctggtctcaaactcctggccttaagtgatctgcccgcctcggcctcccaaagtgctgagatgacaggtgtgagccaccgtgcccggcccagaactctttaattcccacctgaaacttgccgccttaagcaggtccccagtctccctcccctagtccctggtcccaccattctgctttctgtctcaatgaatttgcctaccgtaagtacctcatataaattgaatcataaagtatttgtctttttatatctggcttatttcacttagcataacattcttaagtttcatccatgttgtagcatgtgtcagaatctctctctttttttttttttttttttttttttttttttgcagacagagtctcgctctgtcatctagactggagttcagtggcacgatctcggttcactgcaacatctgcctcctgggtccaagcaattctcctgcctcagcctccttagcagctggaactacaggcgcgtgccaccatgccttgctaatttttgtatttttatgtggaggcagggtttcaccatcttggccaggctggtctcgaattcctggtcttcaccacgggggcccgaaggacccgggcaaagcgtggaggggagg

SEQ ID NO: 6 - DNA, 26928 bp, Homo sapiens
  unsure (12044),(12489),(26433),(26434),(26435),(26436),(26439),(26441): Identity of nucleotide sequences at the above locations are unknown.
gaagaccaagggcacacagcgaggcagtttcagggcgggcagcctggggccccacggggcggccccggacacttgttctcacctgtggagggcagagaagggaacagggagagaagtggccggctgggagtggaggtgggtttgaggttttactgtaaactaaatgtgtaccctctaccttagttatgaattatgagacacgaagactgcgaaacagacacactcctctaaaagtgcctctaggctgacagggagaaagtcccgccaggctcccagacgccacctttgagtccttcaacaagcccgccagggcctcttgcccaccggtgtcagctcagccactgaaccctccaggaagaagacgtgctggtaggagaagaatctcacccaggcacagcctggaaggggcacagaaggggctccggaaccagcaagcccaagttggaactcccagtctgctactttctagaacgactgtgcccttggcgggtctaagtagaacctctccgcgcactctttcctcctttgtaaagtggggacagcaatggccaccttgcaggttcagagagggcttgcagtacctcacagaactgagtgcccgtgaacgtgtgtgttcctccagatttgtgacagctttgccaggctggagtcaggctgaacgcctctgccctcatggggtttatattctaggaagaccaacaaaaacaagaagacggaaaattaaaacaacaaaagccccattgacaggccgtgaagaatgccatgaaaaatgaatggcgttgtgctgcagtctttggggaaacgggcttacggaaagaaggacacttgagctgctaccaatgagcagccgtccggtgggagggcagttcaggaagagcagacatccactgaggaggcgctggggcagagggcagcctggtcgctggattcgggggaggaaccacatcaggccatgagctggagctggtggtagaatgtacaggagaggccagccagggccagctcatgtcagacctcaagcggggaagatgaatcgagaatgcaccccacgagcaatgggaagccagtctacgatttaagcagcaaaaatattttcccttcttccaccctgcatccagctctaccagcacagcctggggttctattttcaagatagaatagacccagactcccagctcttcttacacttctactactgccacctgtcacccactcatgcgtccccacttgcagcctcgacccccttccacctgatctcatggcagccagggaagctccagggctcgtgagggctgccatctcaggaaagaagcaaaagccttcggcacctgcagggcctgctccaaccacacttcttccttgacctctcagcttccttagccactcccttcccacatctcaccctgctccagccacagtggtgtctctgtgggttctcaaacacaccaggtgcactcctgcctcagggcctttgtgcttgctgttctctgctgggactcttttttttttttttttttttgagacagggtctcactctgtggcccaggctggagtgtagtggtgtgatcgtagctcattgcaacctcaaactcctgggctcaagcaatcctcccacctcagcctctcaagtagttagcttttgttgttttgttttgagatgggatctcactctgttgcccaggctggagtgcagtggggcaatcttggctcaccacaacctctgcctcccaggctcaagcaattctcctgcctcagcctcccaagtagctgggattacaggcatgtgccaccacgcccagcttatttttgtatttttagtagagacagggtttcaccatgttggtctggctggtcttgaactcctggcctcagatgatccacctgcctcggcctcccaaagtgctgggatgacaggcatgagcctgtctctagtagttaggactacagagaggggccatcatgcctggtgatcctcccaccttttctgctccaactctttcaccccacttagcctcgtggctcactctcttacctcttcagctcctcagtcaggcctgaggacccctgttgaaaattgcaaaccacaccccccaccaccaccacccactattgccagcactttctactccatttctctgctttacttttctcctttgtactcatcaccacctgactcattacatgtttacgtatctttcttctctccactagcatggaagctccaggagagcagagagtgtagttttattccctgatgtgtttcctgtgcccgtaccagggcctagcacacagtaggtgctcagtaaatgtgtgttggatgaacaaatacagtgaaaggatctgatctacatttataaagaaggcactctggctgctgagtggggatgagactgtcaggaggaaagaggcccctgtgggggcctggccagcaggtgggtacaatggtagcagccaggagagagggcctcttggactcaagtggatggggcctgctcagggctccggccacaggaacaaagggaagggggcccaggatggcctgtcatagaggacacattacaactggcccaaagttcaagtcaggtttctaaatttgggaagggatacagaaaaactaaagactctactggacagtcagttattgaaatgattacatagaaaatgtaccaagaattaaaaaaaaaaaaaaaaagcattatgaaggggccaccagagactcccagagaggaaagggactatgggctggatgcggtgactcacacctataatcccagcactttgggaggccgaggagggtggatcacgaggtcaggagttcaaaaccagcctaggcaacatggtaaaacccccgtttctactaaaaatacaaaaaattagctgggcatggcagcatgtgcctgtaatcccagctactcgggaggctgaggcaggagagttgctagaacccaggaggcagaggttgcagtgagccgagattgagccactatgctccagcttgggcgacagagcaagactccgtctctaaaaaaaagaaaaaaaaggccagatgaggtggctcatgcctgtaatcccagcactttgggaggccgaggtgggtggatcacgaggtcaggagatcgagaccatcctggctaacatggtgaaactccatctctacttaaaatacaaaaaattagccgggcgtggtggcgggcacctgtagtcccagctacttgggaggctgaggcaggagaatggcgtgaacctgggaggcggagcttgcagtgagccgagattgcgccactgcactccatccagcctgggcgacagagttagactccgtctcaaaaaaaaaaaaaaaaaaaaaattagctgattagttgggcttggtggcgggcgcctgtaatcccaactactcgggaggctgaggcgggagaatcacttgaacccgggaggcagaggttgcaatgagccgatatcacgccactacactccagcctgggcgacagagcaagactccatctcaaaaaagaaaaaaaaaaagaaaggggctgtgctgtggcctgggacccaaagcacactactgcaaggtcccagggtgcctgactccaaccggagccttgagaacattcatttgcaaagaatgaattaaaattcagcactattttattctgcaggattccagcaccccaaggacagtcatttttagacccttcagtaacgtaataagtaaccggaggatgtgctgagcttccacttccccagacggttgcctgtcacagctcatcaggccaacaaacttttcttaggcctcaaatttggaaatgttcactctcagttcgttccttagatgcaagtccatcccaatgaagtaacaggggctcagcacctgtccaatctcattgcttccggggacaggggcccatgaggatgtcgtttcagcccggtgacacttgggcaaagtgccttttggtttccctcccaggctggaacgtgctggctctgtgaagttacgctgggcacaagagccccccccaacccggcaggactgactgctgtggtcagaggcgcccctggggctttgggagccacagaatcttcctgagggcagcgccggaggaggccccagtgagagtgcccactgccaggctcattcctcaggctgccgcaggcctctccccaaaacaggcaatgcttctcagcaacctgccccaggagcaggccagggaaggccgccatcggcctacagtgctgggctctggagggcttggttggtaacaggccatggtttctatgagccagctggggtgtgaaggacacaggctggattcacctctctgggcctcagtttctgcattcaaaaagtgggaatcatgatatctgctctatttcttatctctcagtgctgatgtgaacctccaataagacttttaaaaatactctttctaccttacttttatttttcatttattttaagataatgtctagctgtctcacccaggctggagtgcagtggtgtgattacggctcactacagccttaacctcccaggctcaagtgatcctcctaccacagcctcccaagtagctggaactacaggcatgcaccaccgcacctggataattttttcttttgagacaaggtttcactctgttgcccaggctggagtgcagtggtgcactcttggctcactgcagcctcaacctccctgggcttaggtgatcctcacacttcagtctcccaagtagctgggactacaggtatgtgccagtacacccagctaatatttttgaaggatggggtttcactatattgcccaggctggtcttgaactccagggtttaagcaatctaccttcctcagcctgccaaagtgctaggattataggtatgagccaccccccggcctataatcctaccactttaaaaaagcctgtaattttagcactttaaaaaatttttctaaattttttatagagatgggggacagctgtggtctcactgtgttgcccaggctggtcttgaactcctaggatcaagccatcctcctggcctggcctcccaaagtgttgggattataagcataagccttaccttaccttttttttttgagttgcagttttgttcttgttgctcaggctggagtgcaatggcaagatcttggctcactgcaacctccacctcccgggttcaagcaattctcctgcctcagcctcccgagtagctgggattacaggcatgcgccaccacacccagctaattttgtatttttagtagagatggggtttctctatataccttaattttaaagcactgcattcatgtaaattgtgattaacatggattcaagagagggagtgaggatgaatgagccaggcagtcacctcggctgtcaccctccacttctctcctccttctgacagtcatcgtccatccgtttctgcagctgtttgtttgactctcctgatcattttgcttgccacataacttgcctcctgggaaagaatgccctgggcaggcccacatgagtagtgaaaaataatctgcagtgaaaaataaaactaagtagtctggtccacagagcagtcttattttttcactgcagatgaaggagttgacattcaggcttcattctcatttataagtgttttaaagacacatacagtggattgaacagtggccttcaaaaagatgtatctacatcctaatccctgggacctgtgaatgttaaccaagttaggaaaagggtcttcccgggtgtcattaagttagagatcttgagatgaggagctcatcgtggattatccaggtggaccctgcatccaaggacaaatggtccttagaaaagaaaagcagaggctgggcacagtggctcaagcctgtaatcccagcactttgagaggccgaggtgggtggatcacctaaggtcatgagttcgagagcagcctggccaacatgatgaaatcccatctctactaaaaatacaaaaattagcaaggcatggtggcgggtgcctataatcccagctactcaggaagctgaggcaggagaatggcttgcacctgggaggcggaggttgcagtgagccaagatcgcgccactgcactccagcctgagggagaaaagtgaaactctgtctcataaaagaaaagaaaagcagacagagatctgagacagaagaggagagtgaaggaaaaaaggccatgtgaagatgaggcagaggttggagccatgcagccacaagccaaggaatacctggagccccagaagttgcaagaggtaggaagaagcctcccctagagcctccagacggagcacagccctgccaacacctccacctcagacttctggcctccagcactgtgagataatcaactgctgttgttttaagccaccagatttgtggtaatttgttatggcagccacaggaaactaatacagtacctaatcttcacaaacccatcttacagaaaaggaaactgaagtcagagaggtagtggcttgtgcagtgtgttaggccattcttgtattactataaagaaatacctgaggccgggcatggtggctcacgcctgtaatcccagcactttgggaggccaaggtgagtggatcacttgaggtcaggagttcaagaccagcctggacaacatggtgaaaccccatttctactgaaaatatgaaaattagccaggcatggtggcgtgcatctgtagtcccagctactcaggaggctgaggcaggagaatcacttgcgcccgggaggaggaggttgtagtgagccaagattgtgccactgcactccagcctgggagacaagagagaaaccctgtctcaaaataaataaaaaacaaataaacacctgagactgggtagtttataaagaaaggggttaactggctcccggttctgcaggctgtacaagcatggtgccggcatctgcttggttgctgggaaggcttcagggagttttactcatcgtggaaggcagagccagagcaggtgcatcacacagcaaaagcaggagcgagagagagagagagcagggaggtgtgcacacttttaaatgagcagatctcacgagaactcaccattgcaaggacagcaccaagccacgaggggtctgcccccatgacccaaacctcccactaggccccacccccaacattgggaattacagttcaacatgaggtttggggggacaaatatccaaactatatcattccacccctggccccccagatctcatgttcttctcacattgcaaaatatagtcatgccttcccagtagccccccaaagtcttaactcatcccagcattaactcaaaaatcccattcccaagtccaacgtctcatctgaagatgagttcctttcacctacaagactgtaaaaatgaaaacagttatttactgctgagatacaatgggggcataggcattaggtaaacattcctgttccaaaagggagaaatcggtcaaaagaaaggggctataggccccaagcaagtccaaaacccagcagagcaatcattcaatcttaaagctccaaaataacctccttaaactccatgtcccatagccagggcacactggtgcaaggggcaggctcccaaggccttgggcagctctattcctgcggctttgcagaattcagtccccatggctgctcttacagattggagatgagggcctgcggcttttccaggtgcagggtgcaagctgctggtgatctaccattctggggtgtggatggtggcggccccgtcccgcagctccactaggcattgtcccagtggggactctatgtggggcctccaaccccacatttcccctccaatgggaaggctctgcccctgcagcagccttcttcctgggctcccaggctttctcatacatcctctgacatctaggtggatggtgtcaagcttccttcactcttgcactctgcacacctacaggcttaacaccacatggaagctgccaaggtgtatggctggaaccctctgaagcagcagcctgagctgtgactatggccctttgagccaaggctggagctggaacagtctagatgcaggcagggagcagtgtcctgaggctgtgcagagcagcagggccctgtgcctggacaatgaaaccattctttcctcctcatcctctgggcctgtgatgggagggttgtggaagatctctgaaatgcctttgaggcctttttgcctctgaggcctatttcctattgtctcagttattggcagtcggctcctttttagttatgcaaatcctctagcaagaggttactccactgccggcttgaactcctctcctgaaaaagctttttctttctttgtcacatggccaggctgcaaattttccaaacttttatgctctgttttacctttaaatataacttctaactttaattcatttatttgctcctgcatttgagcatagggaattcaaagaagctgggccacatcttgaatgctttgctgcttcaaaatttatggccacgcttggtggctcacacctgtaatcccagcactttgggaggcctaggtgggcagatcacgagatcaggagatcgagaccatcctggtcaacatggtgaaacccatctctactaaaaatacaaaaaaattagcttggtgtggtggcgcagacctgtagtcccagctactggagaggctgaggcaggagaattacttgaacctgggaggcagaggttgcagtgagcccagatcatgccactgcactccagcctggtgacagaataagatttgatctcgaaaggaaggaaggaaggaggaagggaagaaatgtcttccccccagatgtcctgggtcatccctcttatgttcaaacttcaacagatccctagggcatgaaaataatacagccaaattatttgctaaggcataacgaaagtgacctttgctccagttcccaataagttcctcatttccatctgagactcatcaccctggccttggcttgtccatatcactgtcagcattttggtcacaatcatttaaccagctaatcgggaggctgaggcaagaggatcacttgaacccaggaggttgaggctgcagtgagctgtgatcacatcactgcagtccagcttgggcaacagagcaagatcctgtctcaataaataaataaataaatacataaataacttaagtttatttaaagctgcatctttgccaccatggagaaaggccaggccagctccttctctctttctgcacgtgttcctcccacctcagctgcctctgctcctcaaggaggaacagagggagtaggaaaggccatcccaggaggcccagcaccccatgacctggctctggggccttgtgggtttatggattcccagtgctgagtcatccctcacaggctcttgtgggcaccttggacattggtcagaagcatgtggtccccgggaacacaccttttcctgatcatctgggaagggcagcttgtgccagcgaggccacctgttcagcgccacggcccgccagacagctgcagccacagccttgcctttgatcagagcaaacaccagacatgtgtgtcatgcccccaacccatctccaggggacacatgtcctttcttgccaggcctgagatgaacaagagagggacaagtccccaagcctctctctccttcctgcctcacccactccgctgttagattctcaaggtggatggtgggctaactagggcaaccgaccatcctggtttacctagaactgagggggcattttcaggaataaaactgcaaaagtctggagcaaacaggagcaagttggtcactctggggctggtggagtcaggtttccttctgcaggccccctccccgcaagcatgggtggaacccaggacaggaacacagagcaggccccaggaccgggcttgtcacttacaagtcttttttttttttttttttttgagatggagtcttgctctgtcatcagggctggagtacagtggtgccatcttagctcactgcaacctctgccttctgggttcaagtgatccccctgcctcagcctcctgagtagctgggactacaggtggcaccaccacgcccagctaattttttgtatttctagtagagatgagatggccaggctggtcttgaactcctgacctcaagtgatctgcccgccttggcctcccaaagtgctgggattacaggtgtgagccactgtgcctggccccactcacaagtcttaaaccatgcctcagcacatcaatgccatttacaaaaaggtagagggattttccaggcaaaaatagatgaaagacataggatgattgatcatgtcctgcttaaacataggtctgatgctattaagaattgagggctgggagcggtggctcacgcctgtaatcccagcactttgggaggccgaggcgggcggatcacgaggtcaggagatcgagaccatcctggctaacacggtgaaaccccatctctactaaaaatacaaaaaatggccgcgcgcggtgactcacgcctgtaatcccagcactttgggaggccaaggcgggcggatcacgaggtcaggagatcgagaccatcctggctaacacagtgaagccccgtctctactaaaaaatacaaaaaaaattagccaggcatggtggcgggcgcctgtagtcccagcaacttgggaggctgaggcaggagaagaatggtgtgaacctgggaggtggagcttccagtgagccgagatcacaccactgcactccagcctgggcgacagagtgaaactccatctcaaaaaaaaaataaataaataaataagaattgttagtattttgcaggtgtgacaaatgattctgtttctgtggcagaatgttctcaggagatctcttttgaactctcatggaaagcatcatgctgttggcaacatcacatttatttttatttatttattattttttagagacagggtcttgctctgttgcccaggctggagtgcagtggcacaatcacagctcactgcagcctcaacctcctgggctcaagcaatcctcctgcctcagcctcccaaagtagctgggaccacaggcgtgagccactgcactcagcccaatgtaccttcaatatttacatttctggcaaaggtagcaaaaccttaacaaattttgaatctagataataaaattatgaggctgggtgcagtggccctgacagggatggctcacatctgtaatctcaacattttgggaggccaaggtaggcggatcacctgaggccaggagtttgagaccagcctggccaacatggtgtaaccctgtctctaacaaaaatacaaaaaaattagccagacgtggtggtgcacgtctgtcatcccagctactagggaggctgaggcaggagaattgcttgaacccgagaggcagaggttgtgatgagccgagatcgcgtcattgcactccagcctgggcaaaagcaagagcgaaactctctctccaaaaaataaaaaaaaaataaattaatgaattaattaaaataaaataaaataatggatagtcactgtaaagaaaaaataaatgtatatatcagccaacaagtgatggaatagagcaccccatctccctggctggacagatacatcccacaacacctggaaggcggctccatgtagaactttctggactgcttgaggtgctgtgctggagcacggtgacagaggagctggaccatggacctcccccggcccccaccaagggcgaggtccccctgtggtgggtctgagggaggcatccgtatggcctctgcggcttgggcagggaatttggggtccaagtacttggtgcaaagcctggaaagagggtttgggtgctgagggcatatcccctgggccacatgggggcagaagtggggccccctgaagcttggagtcctgggcaggggcatctattttgctgtctgaggccttcagtacttgaagcaaaatggaggcagaatgtcccaccttaatgcccctgattcctccaaaccaattccagagacagcaagggccagaacagggatggccctgcccagggtcatgcancgaggaagtggccaggctgggatctgaacccaggctaatcccctcccttgtcctcctccaggccctcacccctgcatagagccctccagctcactcatcctcggccagctccatctcctcagcttgtaaacccccccgggattttcctttcttaaaaaacaaaggcttggccaggcacggtggctcacgcctgtactttgggggtggctcccagcactttgggaggccaaggtgggcggatcatgaggtcaagagattgagaccattctggccagcatggtgaaaccctgtatttactaaaaaaaaaaaaattaactgggcatggtggctagctacttaggaggctgaggcaggagaatcgcttgaacctgggagaaagaggttgcagtgagccaagatcgcgccactccactttaacctggcaacagaacaagattccgtttcnaaaaacaaacaaacaaacaaataaacaaaaaaaggcggagcgcgatggctcgcgcctgcaatcccagcactttgggaggctgaggcgggcggatcacttgaggttaggagtttgagaccagcttggccaacatggtgaaaccccatttccactaaaagtacaaaaatcagccaggtgtggtggtgggtgcctgtaatcccagctactcaggaggctgaggcaggagaatcgcttgaacccatgacctggaggctacagtgagctgagattgcgccactgtactccagcttgggcaacaagatttgtttctctaaaaaaaaaaaaaaaaagactggcccttccccttcagctcttcctcagggtccctgagcactctacacccccgtctacactgagcactccaccctgctgtctacactgagcactccaccctgccatctacactgaggactccaccccactgtctacactggctgcctcccgccctcacctcctgctaaggccattccccgctgcatctgtcttctagattctgcagccttcagcacgctgggcccctcctttgtccccttgagccacctccagcctccccctgagctgctactcctctcccagcagcctccacccaagcccctccagtccccaagctgtcccttgcatccagcactgcccttccacgtgccccttccctccagcttcacagcagggtggggcctccaggccctgcccactgtgcccatccacaagttgtggtgggagctccgaggggaggcaggggtgtgcatggacttgggacgtccaagtctgggaccaggggcagctggttggtggagtgtggagggggatagggactttcaggtagagaggctgtaggggcaagatcgggacggcggatgtccctaaggagggctctgacctgggaaatattgtgcagcttcctctttgccattcctggagctcagacactggccggctctcaccccgcccttcctgcaggacacagctccatcccagtgagttcctagtgtagacatctccagcagcacggatgggaaaggaagtcatcaaaggtgcccaggaccggaggctttttctggaggtggcagaggagggtgtgggtctcagggctctggctgagggcaagcgtgggaggtcttaggtctgcaccagccccgtgaaggcccctcctgctccctggtggagtcctagagggaacagcagcccctaggctctagcaggagtgggtaggggcttttctggcttcctactgtgccagcaggatagctgggcctggcactgagcccaaagatcacatgccggggcattggcgcagtgaggaacagacccttgccaaagctggcaaagaagaccccatggggtgcagctggtgaagctgagagctcaatgtttgggggagcctggcaaaaggggtcctcccctccctctgcaggccaggatcgcaggttttccctacatgttggtaattctcaaacaatcccatggccactggagcaaagatcacagtgggcggcggcctcgggagcagtggacagggcacgcagtgcctttgatgccagagccctcgccccaaagtcaacaaactctgcagcggactttgcacccggactttgttttcaccatacaaggaaagggacagatcacaggccctctcgctgccctcgctgagccggaagctgcagcgtgagctctctcaagccccatttctaggttccccaggcgcacccctgagcccctactcgcctattaagttctcctaatagcccttcaaggtcttaatgtatgtccattagacagaggggaaaactgaggcgagggcaagtgacttgaccgaggttcctcggcgagcagggcgtggagctgagaacctcgttattactgctccccacacaaccctctggccgttcttggaagaaggctgagccccgggggggccagagtgacccaaacaccatgggccgcctgcggtaacacgtgcggccacgaaggggcagcagtttcccgcccggccgggctctctccggcgctcagtatccgtcccaggccaagaagaagaaactcggggaggagggcggagggggctgcgtgggagggcgtggaagatggacgtggccaggggagtggcagctgcacacagtggatgctgttaagatgaagggaaagaacgtgggctccgagatcactggacacggttccacctttcttcccgctcactgcatggccctgggcgggttgttgaacccttggaaacctgtttttccttttttcctttttttttgagacagggtcttgctctgtggcccagactggagtgccgtggcacgatcttggctcactgctgcctcccaggttcaagtgatcctcccagctcagcctcctgcgtagctgggaccccaggtatgtgtcaccacagccggctaatttttgtatttttttgtagagacgggatttcgccgtattgcccaggctggtctcaaactcctgagttcaccggatcttcctgcctcagcctcccaaagtgctgggattactggcatgagccaccgcacccagcagagacctcagttttctaacctgtgccagcaggaataatgatagctgcctagcttggctgtgctgggaattaagtaagatgaccgggtagcaaatatgaagtattactggacacagagggccccaggctgggttagcagcggtggtcagggctgctgcttcctggcctgagctcgaaggagggccctcattaccacctgggtgagtcctcgtccaagcctggcactgctgcgtgggaataacttctgccacccaagttggcagattgtgtgcaaagttaagtcctgactctgtggggtggacttcgaggcctcttcatcggacctgcttccggtgactgcattcgcacctcctcctgttcctggtttaacacagcccagctttcctcctgctgagccctccctgggcctgctgtcaccctcgtgccgctgtgcctcgcagtgccactccctgtaccctgaatactttgccctgcctctccacccagctgagagtcagggcccctgtgaggctctgcccagcccgtcctccgggtttctgcctctgctgagcacttccctgcatgattgcttctgagagtccccccagcctgtgagcttctcaggactgggacagcttctcaggaccgaggcttcctggtctgcttgcaattttacaggcgggcacattttcccttggccaacatcagagactggacatctgcagatctgtgctagccactgagcacccaggcaccccagcaggtagctctgtaaccaacccattctgtaaagctgaggctcagagaggtgaagcgcctggcctggggccacagcctgcgtcagctgcagagccaggagctgagatatgcacctgcggctctgctcacagggtcctgcacagactgctgctggagccacctatgtagagtcaagagagttcatgttaactccctctcacatccctcagccagggtgggggctgacgatagacactcagggatggcctaccctccccaacaacccccgtcaggtttgccggatctccttggaagaaaagttctgggcagaattccaccgttggcctggcctacactctccttagtggcttaggaccctcagcggtggataagttgtgggcagaagagatgcaatcaggattctcacccactcaccccttgccagccccaataagctcaataagctgggctcggtctgaggaagtgtccaggaaatgtgcaaatggcctgggacagccctgtgttcctttcagtaaggttgctgaaggtgaggctgaaagttggagaaacagaagccagtgcttatggttttaattaagataatggaatgtatgtatgtatgtatgtatgtatgtatgtatttatgtatttatctttagagatagagtctcactctgttgcccaggctggaatgcggtgacacaatcatagctccttgcagcctcgacttcctatgcccaaatgatcctcctacctcagcctcctgagtagctgggactacagacacacgccaactatgcctagctaatttttatttctattttttgtggagactgggttctcactttgttgcccaggctggtcttgaacccctagcttcaagcaatcctcctgcctcagcctcccaaagtggagggattacaggtgtgagccaccacacctggcctggaatttatttgtattctgcttataaaattaatacattcttattgcagaaaagtttgaaaataaaagaaaggacaaagaacaaaaagcgtatataatttcacagctcagatctcactgctattaacatttttatttactttcaggcttttttctttctaggtacatatgcagagattattttattttatttattttattttatattttattttatattttttatttcattattttattttattttattttattatttttagagacagggcctcactctgtcacccaggctggagtacaatggagtgatcatagctcactgcagcctcaaacacctgggctcaagcaatccccccactcagccttctgagtagttgggactaaagtgtgagtctggctaattttttttactttttgtattgacagaggtctcactatgttgcccaggctgatctcaaactcctgggttcaagcgatcctcccaccttggactcccaaagtgctgggattacaggcatgagccaccatgcctggcctaaaatgccactttttgtcatttactaaaatcccatggacactttgacatgtctgtattctatgctattgatctgactgttggcatctacatcattatggccatctatcatctatcataatccattttaacattaaaattgtgctgctgcttagatttttctggcctgtctcctatttgtattcttccagataaattttagaatcattttatcaaattccccttgcagaaaaagccctattggattttggttgaaaaatactgaatttttacattaacttaggaaagggctgggcacggtggctcacgcctgtaatccctacacttttcgaggccaaggcaggtggatcacttgaggttgggagtttgagaccagcctggccaacatggtgaaactcggtctttactaaaaatacaaaaattgccaggcgcattggctcacctgtaatcccagcactttgggaggccgaggtgggtggatcacgaggtcaggagatagagaccatcctggctaacacggtgcaaccccgtctctcctaaaaatacaaaaaattagccaggcgtggtggtgggcgcctgtggtctcagctacttaggaggctgaggcaggagaatggtgtgaacccaggaggcggagcttgcagtgagccaagatcgcgccactgcactccagcctgggcgacagagtgagactccatctcaaaaaaaaataataataataatacaaaaattagccgggggtcgtggcgtgcacctataatcccagttacttgggaggctgaggcaggagaatcgcttgaatccaggaggtggaggttgcaatgagcagagatcgtgccactgtactccagcctgggtgacagagtgacactctgtgaaaaaaaaaaaaaaattctgaaggattgagactcttagactcttaggtcttcctatccaagagcacaatatagcttttcatgtattcaagcctttttcaatgcatcaacagaattttacagtttttttcatgatatcctgctatttcttataaaatgtattcctagatattctgcatgttttccggttgtttgttaataaatatttttcatttgtcattatttcctaattggctgttatttgtatatatgacatctgttgaattttttgattactttgaaaatggccattcttttgtgtttttttttaactttctattttgagataattttgacttacagaagatttgcaaaaatagtacagagagttcctgtttcccccttatgttaacccagtttctccttatgttaacatcttacataactacagaacaattgtcaaatctaagaatcaacctgggcacaatgctattaactaaactgcagaagctgttcagatctcaccagttcttctactgctccccttttctcttccagtgttcaatccggaatcctacattatatttagttgtcatttctctttggtgtcttccaatctgtgacagttcctcagtctttctttgtctttcatgactttcatttttttatacttttgaaaaatactggccggttgttttgtagaacgccctcagtttgggtttgcctgaagttttttgtgattagatcgaggtcatgcattattggagagggtgccaccgcctcgatgtgcaagctcaatgcatcatatcagagggtttgtaatgtcagtttataccgccggagaccctaacctggagcatttcgtgaaggtgctgtctgccaggattctccactagaaagttactatttttccctttttaattactgaatgtctgaggggaaatactttgagactatgcaaatatcctgtttctgctttaacttcggctcactaagtttagcattcatctatggatctcgcttatagcaagtattactgtggagttctaatggtaattttctgtttctctcattccttcaacctttattaatatgcttcttcctcacttattcattttgtttcagttgtttataccaacatggatttgtggatattggttttattctttgggttgcaattgaatcctatcattattttgttagtcagttgttccatccgaccttggtcattaggagcccttgaaatttggctcccatgcctttttttttttttttgagaccgagtctcactctgtcacccaggtttgagtgcagtggcatgatcttggcttcctgcaacctccgcctcccaggttcaagcaattctcctgcctcagcctcctgagtagctggtattataggcgctccaccaccttgcccggctaattttttgtatttttagtagagatggggttttattatgttggccaggctggtctcaaactcctgacctcaggtgatctgcccgcctcggcctcccaaagtgctgggactacaggcgtgagccaccacacctggcctcctatgccattttaacatgcccgtcttttctttttctttcctactttctgtgactgtaagaagctccaggatacatttttgctgccctagacttagcctcaatcagttctcagaaaagctctggttctttttatgggatacttagaaaactagctctgtatggcctggcgcggtggctcacgcctgtaatcccagtactttgggaggccgaggtgggcagatcacagatcacgaagtcaggagatcaagaccatcctggctaacatggtgaaactctgtctctactaaacatacaaaaaattagtccaggcgcggtggcgggcgcctgtagtcccagctactcaggaggctgaggcaggagaacggcatgaacccgggaggcggagcttgcagtgagccgagatcggcagccactgcactccagcctgggccacagagcgagactccgtctcaaaaaaaaaaaaaggaaaaagaaaaaagaaaactagctctgtatgctagttttttttttaagacagggtctctcttgccccagctggagtgtagcagcacgatcacagctcactgtagcctcaaccttctgggctcaagcaatcctcctgcctcagtctcctaagtagctgggtctacaggcatgcaccaccgtacgtggcaatttttaaaaactgtttgtagagatggagtctccctatgttgcctggtctggaactcctggcctcaagtgatcctcctgcctcggcctcccaaagtgctgagattacaggcatgagccactgtacctggcctggccaaggtctgtctttttttaaaagaagttgttgtatagttgtttttttttttatttttttttctgagacggagtctcgctctgtcgcccaggctggagtgcagtggtgcgatctcggctcactgcaagctccgcctcccaggttcacgccattctcctgcctcagcctcccgagtagctgggcctacaggcgcccgctaccacgcccggctaattttttgcatttttagtagagacggggtttcaccgtgttagccaggatggtctcgatctcctgacctcgtgatccgcccgcctcggcctcccaaagtgctgggattacaggcgtgagccaccgcgcccggcctgttgtatagtttttatctcgagttttctagcgatttaatcatattggttacaaaaaaggatgattttactacctcctttccaatgtttctacatattttttcattttatctaactgcattttaaaataaacttttaattttagaatggtttcatatttacagaaaatgtgcaaagatagtacagagagttcctgtgtactccacacccggtttccttattattatcttaacgtgatacacaattaataaaccagtaacattattattcactgaagtccacactttctttttttttttttctgagacggagtctacttctgtcacccaggctggagtgcagtggcgcaatctcggctcactgcaacctccacctcctgggttcaggcaattctgtggctcagcatcccaagtagctgggaatacaggtgcccgccaccacgcccggctaattttttgtatttttagtagagatggggtttcaccatgttagccaggatggtcttgaactcctgacctcgtgatctgcctgcctcagcctcccaaagtgctgggattacaggcgtgagccaccgcgcccggcgtccatactttctttagatatccttcctttttacctaacgtccttcttctggttcaggatcccatccagaaagcaacattacccctcgccatcacgtcttcacaggctccccttgacgggaagagttcctcagactttccttgtttttgttgaccttgacagttttgaggaggactggtatcttagtctgttttgtgctgctatcacagactagctgagaccgatacatgatacatgaaaaaaaatgtattcttacagttgtggaggctgggaagttcaagacgaagttgctggttggtttggtctctggtttcaagatggcgccttgctgctgcatcctctggagaagaagaatgcggtgtcctctcactgcagaagatggaagcgctaaaaggaatgaactccctttgccaagccattttataatgggcattaatccacaaaggatgaaaccctgagaaacatcaagctttaaagcactggttctcaacctttttggtctcaggagccctttatactcttaaaacgttttgaggatcccaaaaaaaggcttctacaggttccatcttttaatatttaccatatcaaaaattaaactgaaaaaattttaaattatttattcatttaaaataacaaggataaacccattacatgctaacataaatcatgtattttatgaaaaatagctatatttatcaaaacaaaaattagtgagaagagtggcatgtataattttttttgtttattttttgtttttagatggaatcttattctgtcgcccaggctggagtgcagtggtgtgatctcggctcactgcaagctctgcctcccaggttcacaccattctcctgcctcagcctcctgagtagctgggactgcaggtgcctgccaccacgcccggctaattttttgtatttttagtagagatggagtttcaccgtgttagccaggatggtcttgatctcctgaccttgtgatccacccgcctcagcctcccaaagtgctgggattacaggcttgagccactgcgtctggcctaaatttttgtgaatgtctttaatgcctgccttctcatatttgtttctgcattcaagttattgcaaaatgttgtgttggttgaagtttgtaaagaaaatgtggcctcatacagttgtgtagttggaaaggcaagagtattttgattctctcttcaaacaactatggacaacctgctgttacaaaaccagaatgcaaaaagttgtagtaaatacaggttaggtgtagtgtggaatctgaaagcatgtgaatgaactttctgagttttgtaacattaaagtccagttgcgttaagctactgtgatagcatatagcattgtcctaatactggaattagtatcagaagtggggtgctactgttaataaataaaaagaaataaataaatcatgtgatactggctcagaagtcaggcagtaggctgtgtggaacctgacatcacgccatgtaatacattggcaaccatttgatccagctgtctgtcatgatgacttggaaagtcaaccacatacttacagagcctgtagacataggggaaaatagtataaaacagaatactaacagtggaccttggttcttgccagttgcatttagccaaatattaaacaaaagagatattcttgggcagcaactggaccatcttcaagtaaaagtgaaaggtaataaacagagtccagacatttgtgcccatgcgggttaagaaaaatccagttgcttctagacaccgtatatgaaaacaacgctgaaaacaagcctttgagtggtaaaggccgattaacactcagcgcggtaacaaagaccaggtgggctaacccgaaatgaaatgagaagcctgtggtgatgaggaggcagagaagtaaaatcaagtttgagcatttcgtttaggagagtttgggctctgattacttgcacatgcaaacgaactggaaacaaacagatcagatgtctaccacttcttcgagggaattgcattgccaaagaagtcatgaaagcagactctatactgattaggcattaaaacaaaaacaatctttaggcccctaaacttgcatgggcaggaagtgggctgtcaaagctgttcatcctctaaggtggacctagttcctagtccccagtatacacttcagatgtggccctggaggacactggacatggaggacctcccagaggatgaggctagggcttcatttctccaatgacctcagctgcctctatttccccttcttcctctggaagtcctatcatcgttattattattattatcatcatttttattttgagataaggtctcgctctgttgcccaggctggagtgcagtgacatgatcatggctcactgcagccctcccaggctcaagtgatcctcctgcctcagcctcctgagtagctgggagtacaggcacatgccaccatgcttggctattttttttttcagtagagatagggctctcactatgttgccagggctgatctcaacctcctgggttcaagagatcctcctacctcagctcctgagtagctgggattcgggtgcacaccaccatgccaactaatttttaatttttttttgtatggacaggatgtacagtgttagaaatggattgcttgcagaggcaggaggatcacttgagcccaggagtttgatcacactgtgaaccatgatcgcacccctgcactccaatctgggcaacagagtgagaccttgtctcaaaaaaaaaaaaaaagagagagagagagagactcaaagataggcaaaaaagtgggaaagctttatagtggacaaaaaggaacgctctaagtctgccctattggcatggtgctgaaggtgggctaactagagatagggggtactatgtggttgactatgggtgcatctttggctttccctgggtgatcctaagttggaagcagggacaaaaattagggaagctgttagttattcatcacgttctggcagtagtggactggttgtgatagaagttattgttttggccaggtgcggtggctcatgcctgtaatcctagccctttcagagttcaacgtgggtggatcaggaaggagggaggatttgggaggtcaggagttagcctggctaacctggcgaaatcccatctctactaaaaatacaaaaattagctgggcgtggtggtgcatgcctataatcccagctactcgggacgctgaggcaggagaatcagttgaacctggggaggcggaggttgcagtgagccaagatcgtgcccaatttcatctcaaaaaaaaaaaaaaagttatcgtttagcttcctcgattgttactggacgtagtaatctggcttcctgcaagtctaactttcagcagactggctacatgggctgtgtactgtagataaggcagtaagtaaagcaaaaattgatagagcatcaaggataaatagaaaatccgtaatcaagcagaagatttgaacacttcactttcagtaactgataaaacaagtagacaaaaaaaatcagtaaggatgtagaagatttgaacaacgtaattaacaaacttgacttgatttacacgtctagaaccctgcagaacacacactttttcaagcatactcagaacatttatataaagtgaccatatggtggaccataaagcagtttcaacaaatctcacaggagtaaaataacagaccgtgttttctgaccgtaagtacagttaacctagaaattgaaaacaaaaagctagaaaaaccccatgtatctggaaattttaatatacactttgaaataacaaatggatcagagattaattcaaataggaatttagaaataccttgaactgaaaaataatgagaatactataccccaaaactgtggggtgcagctgaacagtatatagacgaaaagtatactcatatgtgcataccttaaggagcggggaggattgaaagttaatgggaggcaaaagcaggtggatcacttgaggttaggagttcaagatcagcctggctaacagggtgaaaccccatctctactaaaaatacaaaaaattatccaggcgtagtgaggctgaggcaagagaatcgttggaacccaggaggcagaggttgcagtgagccgcgattgcgccactgcaccccagcctgggagacagagcgagactccatctcaagaaagaaaaaaaaaaaagaaaaggccaggcgcggtggctcatgcctgtaatcccagcattttgggaggccgaggtgggcggatcacgaggtcaggagatcgagactatcctggctagcacggtgaaaccccgcctctactaaaaatacaaaaaaattagccaggcgtggtggcgggtgcctgtagtcccagctactcaggaggctgaggcaggagaatgtcatgaacccaggaggcagagcttgcagtgagccgagatcgcgccactgtactccagcctgggcaacagagagagactctgtctcaaaaaaaaaaaaaagttaatgggataaacatccatctcaagaagttagaaaggaatgacaaataaaccaaaaaaaaaaaaatcaaaagaagaaaatcataaggtcaagactataaagagagtggctgggtgcagtggctcaggcctgtaatctcagcattttgggaagcagaggtgggcagatcacttgagcccaggagttcaagaccagcctgagtaacatagagagacctcatctttgctgaaaataaaaataaaaaattagccaggcatggtggtactgaggtgggaggatcacttgagcctaggaggttgaggctgcagtaagccatgattgtgccactgcacttcagcctgggtgacagagtgggaccctgtctctaaaaaactaaaataaggctgggcgcggtggctcaaatctgtaatcccaccactttgggaggccaaggctgaggtcagcagtttgagaacagcttggccaacaagatgaaacctcatctctactaaaaatacaaaaaattagttgggtgtggtggcatgtgcctgtaatcccagctacttaggaggnnnnctntngattatattttctccttcctacgtcgttattggactgaattcagaatgatgactctcattggagctcttcctgtctcctaactacagtggcttccgaccccactctggttttcacttcacccctctgctgctcatacgagtagatacttccttccttctttctcacttgttgctcttcctcaaccccccccgttggtgtcccctcctctttatctttttctcgcgacacctgcgttctcttgccctcttatcatccctttctcgaggcggtcctttcctttatccagcttaaataccttctcctctgtttatttgggggttgggtttttatctctcaccctccctctaatttctttcctctttccgcacccatcaagcctctcgtggtttctcttcctctactctcgggtcccccccctctccccttctttttttcttcacccccccaagcgctttgccttttttttctttgccctttattcccccc

SEQ ID NO: 7 - DNA, 29430 bp, Homo sapiens
  unsure (4336),(4345),(4349),(4392),(4447),(4490): Identity of nucleotide sequences at the above locations are unknown.
aggggaagggccggctccgtagctcacacctataatcccagcactttccgaggagagaggatcatctcaggccaggagttcaagaccagcctgggcaacacagcaagaccgcatctctacaaaaacttcttttaaagcttaaaaaaaaaaaaaaaagcaaagaggacagttcaggagaaaagcctgtagaggcagcacactaaggaggagacgcagcccaggcaccaggaggggctggccatgggcactcactcctccagcaggcgagtgcccagcaccagctggcccacccagacacccaggacacggcctgaatggctccgtattcacgtgggtggtaataaacaagcaatacacatagccaataaggacaccttagtaatgttacatcataaacgctgcagatcagggaaatggtgcagggtgaagtgggttggggggctgcatgctacatgagaagtgggtcggggggctgcatgctacctgagacagagcaggccttgctgggaaagaaggagccggcaggcctgggcaaaggtcctggggtgggagcacactggagcagagtgtgggggtagcatggcgggtgctggtcctctgggcgccttcccaccacgtcatgtgcccatgtgcccaaggtctctcgtttcacagccccctgaagctcaggggtcacagctacacagcccccagataccttggcctgccccaggtcattccatccagtgatggacctgctgacctctagcctgacctctgggcagcgtaatttgagaaggaggagaagggagggcaacagacctggggcgatgagggatgcacagggtggcagacacctgaggctgcaccttggagcctcagttctgggtgtgggtgggggatggacaggctgagggctgaagcagctgggcccggccaccatcacaccccaggacccaccagatcaccatgaaaaaccgaatgtcaactggcagcccagagtgcagaacaaacctttcagaaacacggtggtgactgccgcatcatgaacataaaataattacgccctctccccagggatcacccctgcaggagtttgtcccaagaaacaccagaaagaaggaaaacgtctgagtcacaatatttgctgaggccttatttgtaatagcaaaaaaaaaaaaaaaaaaagaacaatctccagcggcaggggtaactagactattgtctccgtggaaaggtagcaccaattaactagtaacaaaatgactgcggtaacaacaaaacgttcgacatgtcaacaccaaaaaccacacacccagcataaccgtgaaccatgatttctactagaatgaatggcagttatgagaaagcaccagcggagacaaagattgaaaaagtaaaggtggcctcattagggagacaagtctctgggtaatatattgtaatactggtaaatatatagtttttaatatattttttaattccaaattccatatatgttcctatgaagctatttctgcaaatatttttttcaggaccgtacatcacaaaggcaaaagggccaggtcagctctccagctgagagtgaccacttcagagcagacggcagactccagggttagcaagcctggctgagacctggcccatgacaatcactcaacccctctgacctcaacatcctgtctgtgaaatggggataattactgcacctccacatcacagagtgcgaggcttaaacaggatgcttcatagaaaagcgctcaagaggtaacagccgggagggggtagtggttttcattaattaaatgttgccttcatccagccctgggccagctccaacacaaagcacacaccatccactcagactcagttgcctggattcaaagcccggcctggcctccagctgtgagattccgggcaggatttcccatctcccagagcctcagtttcctcattcatgaaacaggaagtgatcattccttttatttttatttttatttttattttgagacggagtttcactctagttgcccaggctggagtatgatggcgcaatctcagctcactgcaacctcggcctcccagtttcaagcgattctcccacctcagtctcctgagtagctgggattacaggcacacgccaccacgcccagctaattttgtatttttagtagagacggggttttgccatgttggtcaggctggtctcgaactcctgacctcaggtgatccgcccgccttggcatcccaaagtgctgggattacaggtgtgagccaccaagcccagttgacaactgcttttaaagacacctctggctgctgtggaaaacagcctggtagtgcctcaaaaagttacacatagaatgatcctatgaccagtaattccactcctacatatatacccaaaagaactgaacccctctactcatgtatgtacacatacaggtacacgcatgttaacagcagtgttcacaaagccaaaacatggaaacagctcaaatgtccataaccgatgaacggataaatgaaacgtagtctattcaccacctgacggaggtgagaggggccataaaaaggaatgatgcataaaaacgaatattatggccaggtatggtggctcacgcctgtaatcccaggactttgggaggctgaggcgggcggatcacgaggtaaggagttcgagaccagcctggccaacacggtgaaaccccatctctactaaaaatacacaaattagctgggcatggtggagggcgcctgtaataccagctactccggaggctgaggcaagagaatcccttgaacctgggaaacagaggttgcagtgagctgagattgcaccactgcactccagcctgggcgacagaccaaaactccgtttcggaaaaaaaagaaaaaattagccaggtgtggtggcgggtgggtccctgtaatcccagctctacttgggatactgaggcaggagaaccacttgaacccgggaggtggaggtagcggtgagctgagattgtgccactgcgctccagcctgtgtgacagaaggagactctgtctctaaaaaacaaaaacaaaaaaggcccgacgcggtgtcttacacctgtaatgccaacactttgggaagccaaggcaggcagatcatctgaggtcaggagtttgagagcagcctgggcaacacggtgaaaccccatctctactaaaaatacagaaattagccaggtgtggtggcacatgcctgtaatcccagctactcgggaggctgaggcaggagaatcgcttgaacccaggaagcggaggttgcagtgagccgacattgcaccattatactccagcctgggtgacagagtgagattctgtctcaaaaaaaaaaaaaaaaaaaaaaaaactaaacaaaagcaaaaaaaccaatgagtaatgttgtcaagtgaacttcatcccaatgggaatgcagataatttgtttaaaaggcaccatgcacactgggcaggctggcttcccctgggaacgtcttcttttgcctggattcccagttggtttaatcgggcgtagaacactttcttcaatccgggattcaggcacccctgctcagcacaaactcagtacaccccgcactctgctgtgggttcttggcactattaggagaatgtgagggggtgattcagatctatctctagtgggtgcatgtctgccactcccaggaacgcccacttctggcaagtcagtgtcagagaaaggccagctcgtggcccctcctgccttgagtcccaggacccgtgatcagtcctacccggagcagaatcaggagtttgaaaacccaagtgccaacaatctcattttaacccatgtaagcatatccaatatttatatatagaattcataacagatgtctgggcttccattccaatagcctatattttacactgtttatttacatggttacaccaaacaagactcaattcaaggtaacccaatcctttgctactataccaaaataagcaacattttcagtccatgccttatatatattcaccaagcattacactaggcctccaactgctcatcggagcaagctgcagcctggacacaagctagagattaatcagtcaggaatgatcctgcgtccagtgccagcatgatggaagagacagagaaacagaagacatcagggctccagagtcaaggagcctgcaggttagttgggcaggatatacacacatacacacacacacgcacacacaaaaccacccaagaagaaaaggtgggatgaatgcatggacaggtaatgcctggagcctggggatggataagctgactgcaggtggcccaggcaggcttcctggaggaagaagacctggctgtangtggggtangcangctttctaaatggggaaaatctggctgtgggtggagttggcangtttccgaaaagaagaaaagctgactatgggtacacctggctgttggtggaacangcaggcttcttggaagaagaaaatctggctgtgggtggatcangcaagcttcttggaagaagtaaacctgactatgggtggaccaggcaggcttcctagaggaagaagaccggctgtgggtgaaccaggcaggcttcctagacagaggaagatctggctgcggttagagtgggcaggcttctaagaagaggaagggctgactgtgggtagacctggctgtgggtagactgggcaggcttcctggaggaggaagagctggagcattgaaaaacaaacatgacttggtgaatgttgagcatgcccaggcctgatccccagaggcaattacgcactcaagttacttaattctactcacaatgcctcacaaacaacttctctgacacctaacacagctctgggcaccttctagcttcagctcctcaaagcagttattcacgctactaccctgcacacctcctcacaccccaaccccagggacaggagttctgccagatgccaaagctcctgatgccaaagcctgggtctgcttccgggctcctcttggtctaactgtccaccccgcatcggcatgatgtgcaaaaacaaggctttgcaatctgccctgatgcctggcggagcgagtccctcccgattcgtctccttcagaaacacctgggctgccctggtcctgttatacccccaacacattctacagtcagctccgcaagttccacaaagatcaacgctggcgtttttatggcattttatttacagtttttacaatataaaaaaggaaggatgccacagctcagccagcaggacagacagagatctatgatgcttctgctgcaccattgtttgtggtcaagaaagtctgttttcaatgatttattaaattgtggtgggagatggatggtggcagtggttaccagcaacatgaatgttcttaatgccactgaacttcacacttacaaatggttacgacgataagtgttatatgtattttaccacaattaaaaacaggtaaatgcaggccgggcacggtggctcacgactgtaatctcagcactttgggaggccaaggcaggcagatcacctgaggtcaggggttcgagaccagtctcgccaacacggtgaaactctgtctctattaaaaatacaaaaattagccagatgtggtggtgcatgcctgtaatcccagcttctcaggaggctgaggcaggaaaatagcttgaaaccgggaggcagaggttgccatgagctgagattgtaccattgcactccagcctgggtgacaaaagcaaaactctgtctcaaaaaaataaaataaaataaaaataggtaaatgcaaacatatggtatagtaatattatgggctattatgagctacaaaaaagaatgacttgggactacagttacagccctcattcaggaatttgttttaaatgtgggttggtcgctaaggcatgtacacaacattttgacgttcaaatattcctagatttggacagtgagcacccctctaagctggctcttctgtcccagaggtccccaccagtcctccagaacttctttgctttcttacacaataagatgccccatgctcggcttgtacctttccttgccccagccctagaaccagcttcttcgtggacaagctctgactcctttgggtggagaatggtattcagaaacccagacctgggctctggtgtgctcactgctacttggggtcattgcttctaggcctctctgctgatggaggtaggatatacacgtacagtcttccctcttcccagattccgtacttgagctcgcctacttgctaacatttatttatatcccccaaattaaacctcacagcacttctgcaatcactcactgacttgcagagtgtgaaaaaactgagtcaccatcacacgttccaaactgaggtcaactgaggccacaacgccccatcttcttgctccggctgtcgagatgtaagcaagtgtccttctctcggtctagctagtgccatgctttccacatcactgtgctttttgtgggcaattttgctgtataaaatgtcccctgcacatatgctgctgtgtagtgctcctaggtgcatgaggctgccccacgccttacagagagaatatgcatgagaggctttattcaggtatgagttatagcgtagttggccatgaattcaatgttaatgaatcaacaatatacagtaaataaggtgctttttagagacagggtctcactctgtcacccaggctttagagtccagtggtgtgaccttggctcactgccgcctcaacctcctgggctcaagtgatcctcccacctcagcctcccaaactgttgggattacaggcgtgagctactgcactcagcctaaataaggtgtcttagaaacacacataagacaaggttatgggctgagtgcggtggctcatgcctgtaatcccaacactttgggaggccaaggtgggaggttcacttgaggccagaagtttgagactagcctgggcaacatggcaagacctcatctgtatatttttttaaatcagacaggtgtggtggtgcatgcctatagtcccagctactggagaggctgaggcaggaaaatggcctgagcccaggaggtcaaggctgcagtgacccatgattgtaccactgcattccagcctggggtgacacagcaagacgctgtcttaaaaaaaaaaaaaaaaaaagccaggtcaggtatcgaacagttggcaaaaacgttgtgacctgaggctcacaggaacctagcccgatgtttcccctaggagcaatggttcagtattcaataattcagggttcccagtgactttatggagcataactttcaagaataacaagaaccaactgtacgtgtgtatgtatactcacacttttattttattttattttattttttgagacagagtctcactctgtcacccaggctggagtaaaatggcgtgatctcgactcactgcaacctccgcctcccaggttcaagtgattctcagcctcccaagtagctgggattacaggtgtgcccccacaaccggctaatttctgtatttttagtagagacggagtttcgccacattggccacgctggtctcaaactcctaacctcaagtgatccacccacctcagcctcccaaagtgctggaattacaggcatgagctgccgtgcctagcctacatacacttttatacacacatgcatctatgactatttctctatttctgtgcatgtgtgcgtggcagtacctacagtttcagctatgtgtctgggtactgtctcgtccaagtttgtaagcaccttctccaaagtgcaaagcctggcttgtgttactatccatatgtttacttatttgctcaatcaatttacttattagctccataaccagcttcccatctgctccagtagcctctgctgtcagtcacctctgcaccctaccccaccttgcttccggatgctggatgccaatcacccccgacacctctacatagcaccaccctcgacatgctgcttctttatttcttatttatttgtttgagatggagtcttactctgttgcccaggctggagtgcagtggcacgatccaggctcactgcaacgtccgcctcctgggttcaagtgattctcctgcctcagcttctcaaatagctgggattacaggtgcccaccaccacgcccagctaatttttgtatttttagtagagatggggtttcaccatgttggccaggctggtctcgaactcctgacctcaagtgatccaccttggcctctcaaagtgctgggattacaggtgtgagccaccgcgcctggtctgcttctttaaatgccaggcaccaacatttgtgcaatggggtgggaggaaagaacagggaggagagcacactgccggcccctgcactgaatccactgatcaatctgggggcaactgccatctccatctcctgtcttcctatccgtgaacatctactgcagtcctctccaatgtccttctgtaaagttgtattatgttttgcatacaggccttgcatattagttctcagatataatccatatactttatataaaattcaaaccacatttaaaaaaataaaactagcatgactataacggagtctgcaacattctcacagactttatgataaaacatgaaacttcaaagatacttagggtggggcagggacaatgtttaaggctgcctggaagcctccccatccctgagccagaaagtcctatctccccttcaaggggaaatgcttgaaaaagcactgatcaggctaaaatgacagggatcagggagtaatcaaagtacaagtgagctggtctcctccattctgagcacagcaaagttcagtctctccaagtccaagaatcatacacctgtttgccaagaatgaagttcaggtgtctacaagtggctgaaaatattcattgctgggccattaacaacattcttggcaaaaccataccttagcttctcgtggaaatttcttaaggtagaagaaacaggaaacacccaggctcgcttttatgtagacagttccatgaagccagggaccttccccacatccacgtttcaattacctgcacgcagctcacagtgtattcaacatctacgcgtctctcctactggggtggcggtggccactcaaaccctcatgcagctacgatgaccgcaattttggcaacataatttcatgtttttccttgggcttttacccaagtcagtgacacaattctgcagttgtctaaagattcaaaatgagggacttgacatttacaacaataataaaatcttgggtttcctttaaccaagcacatgttctgccttttagagaaagctctgcaaactcaagctggagtgggatacttgctgacatcttcaagcaccccaggaatagctctactcccccatttccaccttggctgaaccatctatatcccaccaattcccccaacatccctccatccgtccatccatccacccaaggacctgctaagccaggaggtctctcccatctaccccacagcctggcctcagcccacaagggctctctctacatgaatcccaccgcaccagagtagaccaagtctcccgtagactccaccctgaccacctccatgcctccagccattcccacccctaaaaaccctccctggtctctacacccagctgatgaatacttggctgaatgtgacctggcctcctggacccaggtgaagcccacgtcctccgtaagcccgccagctcaccctgcctctgcaccttcactggagagagcccgcacttcacctcctcagggcaggcatggctgatgccacccagtggaatctggtgcaaagcagggcccggtgcagagcagggctgcctgcagagcaaggccctggtgctggggccgagcacctccaatgctggccgtggaaccatccctcccattccaggtgctgtctccatcaagaatgagcgagctgctgacatttgcatgacaataatgaataaataccatattttgcttcaaatccagaatagatgtggccagggttggcatatgactgttgggaaaggacagtttgcctcttcccaaaccaacttggattataaaaagcttttcttaacgaccacaagagcggaggagctcaggggcagacaaaaggaaggctggctgcagaaggcgggagagtggggccttcaggggcgggtggggagagagaaagcctggagctgcacccccaaggtctgtgtacatcaggtgctacagaataacaccacctcttccagcttggcccccacctgccctctcccagcccagtcacccagacagcaccccactccccacacacacctcacatctgcccgcctcacactcaccagcttcggctctcaatgcaacctggaacctgcccttggcctctcagctcagccacccccattcctgttggcccctggccccccatcgaattctctctaatcctaatgcacacacttgcacactcaaacacacacacacacacacacacacacagcccagaggaaaaccataattgactgaggtccaggcaagtttcccgagcagggaccacatttcaaaggtcagggaagcaggcgaacaggaaacatacagggggcacgtttgggggtggagcaggaaataagaaatcacttgcaaaagataaaaagaaaatgaggtagctggtttcagacacctcggagcacacagaacaggacaggcgcctccgggtcttccctcaacagggagatgggccaggcaggtccctgctgctccaccgcagagctgggggctatggccctgacaccaaggccctggggcaggcggggaggcagctgttctcctgcctgtgctcccgggcagggcctggccccacaagggaactggccgaaggctctgcttggctactccggaaagtcctgggagacaagcaaaggacttgctaggtcactccaaacggcccagatgtgacaactgtgaagaagccacaccaaagcaaggtgacagaacaatgttggtgacgtcaggttatcagcttacgctcaactccacttacccggactcacccgtaacctgccgtctcttcccaaccagtaaaggatgcctaggtagaggggcacaaggcctggagcataattaccattttaaaggctctgagaagtcctgcggtgaggaagcctagttcactttctctcccctaggatttcccaactgcgcctgatcacagaacattttttcatttccactcaggaaacatattttgaaaaacactggcctagaggcagaagtgaaatggaaaacacaaaagtaaaactgaacaggaggcactgggcagagaacggtcagaggcgccctgaatcctggaccggtggagatccccagcttggcatgctcccctccctgggcccagaccgcctccccccatttcctggataagaaggctaatgcgcatcagggtgaagggcttgcctgggctacacccccaggctcgccccacaccaatcgcgctcctgcgagagccagtgactttcttgatttggctactgtggaattgtttgcaactaaccaccccagatacagatacaaatgacaggatgatcagatgtaaaggacccacaggtctctgtgatacggcttcatgcagccagcatggctagtgccgtgcagaatgagaatgaccccaggcaagtccttgcctcccagacccagaaccccatggagcccaccagggctggttcacaagcactgtctgggtcgggcagagattccagcaagaggagggaacatccatgcaccggagccagttaccagaagcaaatcgcctcttccaaaacccaggctattaatggagtccactgttgagtggagctggggtctagctatggaatactgcacagcagagatcttcctgagagaaagcagttttccctgaaagccatgtgtcctccactaactgtgttttaattgggcgaacgtctgtatctcattgcagtggccgcgcatgtgctgacaaggggctgggggcggggtggggagcagaagctcaggggcctgggagggaaggaaacaggccaccagggctccccagaaggcatgtatctctctcacaaacacacgcatgcacacacacgtgcacacatactctgcaagccctgagttagcaactgtggaatgtgaccagctcagtgatcccaggacaagctgctagggaatatgacatttgattgatgtctgcaaatgtgcgttttcactaattagaaggtttagggcagagcagagaaaaatatgtatttcagagtcccagtttgacctgccagaaaccagcccattactaacattcttattttcaacaaaatatagcattctgattacataccatcttggttccacgcctcctgccttgccaagcccccggaagcggcccaaggccatggcaaatagtgagagaaacagttccagggtggagactgactcaggggtgtcagtcagtggggcgctgatggccggtgggaggccagcagtcatcaccctctccttgggacagttgagtagctctcccccagggtcatgtggccactcaggttcatatgggaggcgagaggagtggcagagtccaggagagtggctccgaagtcactgttccctccaggcctcagtgtcttcatccattaaatgggtaggctgaggtctgggatgacaaggagggcttgcacttactgaaacccatgggaggctgttcgccgatttcttttattgatggaagaaaacactcgtataattcaagtaccaattaaaaggcaggcactggaaccaccgtctgccaattcctagttttgcctataccaaatttgagcaagttaattgacctctcccagcctcagtttcttcgtctgtaaaatgagggtagggatggcccccagcccacagggcagctggaaggattaaagaaatcaaacatctcttagagcccacctggcacactgtgatacacaacaaatgttagctatttttgtctatgaagtctagattttatatcttgggtgttctaaagcaggatacatttatttaaaaacaaggattttcattaaacacgtaccccacagacagcaaccccatggagactgctcttaattcaggccagtatcgaaacgactctaactacaagctttatacaggtctcttggctgtccttcaaatccaactaaggtggtacttctgaagcactgtgcacatgtgtgtgtgcatgcacacgtgtgggaagggcgggctcacggatccctcaggtaccccacccacgcagtctcaagtcacaaagcgacagagcagccgaggaaggtctgtgccccactggaccctcgtgaagccaccaactctacctctgcgccgtgtcctgcagactgggctaccctttgggtggggaccagcatttgatgcaagaaaggcagacagaaaaggaaaagggcaagttcgactccagataacacagacagtaccaagccccagggtccataaatgccacgcagatggaagcatttactgcgaggccacacagcaaacgcacggatccagggacggaggtgcagactgcggtgcccctgagccatgaccctgcaaattaccaccatgggaaaggaggctgccaaaccccccgacagtcggctgggctggcacagactcgtggtttccatcgaggtgggaggaggtgggacgtcccagcccctcccccatgcccactgcagagggaagcggccgtttcccctgtgtggttacaaaggtctcattgttcttcctcacagggaggaaactggaggaccgagctcagaacgcattttagaactggcagaaaagaacatctggggaaggaaacacatttcagaaacaaacatacctttgtaccagcttttattttctttaagtgttgaaaaaataataataataaagacatgccaaatttatcatcgctctacaaaatccctttattgagcaaaacgtggcagctctactttcaaatgattactgttcctggaaaattgcagcaacgtggatgccaaggcccgaaggccgccatcagcagccaaacaaaagatgccacctcgggctccgcgacactgtaccatgccagggaactggacagatttggggaatgccacggtttgcctttaaccccttgcctcctggtctcctgatgcatctcagaggctaacattctttgaggaactggcatttcttagttgtaaatatgcatgtgggtttgggagctgcctgcaaagtccagtgttgacgatcagctttgatttccttggaatcaagtttacgtgtcgagtctggaagttaagaagaatttggagaagctgagcactatggtgttgcaggccctgggtgaactcttccaccaagcattcattgtggactgacagcgtgcgaggggctctgcaggcaggtgcacaggacgaaacacattccgtccgggggaaacctgcaggaaagctccctcttcttcctaaggtgccgggcctagcttcatgggtccctaccctccacgcctgtcacactttctgagtctcatgtgggagctgcttctggttcctgacttcactcagtcctcataggaggtggaactactgtcaccccattttacagatggggagactgggcacaaggggaccaagaaaccaatgcaaagtcacacttgtgggatcagtgacaggggagatcaattcccaggttctttctgcaagagttaaattgttttcatgctgcctaagggggggcaactgaaagaccactgcatatctttgccaaaagggtcaagcacaggagccgcagccagtgggtcagatccgcagaggcgctggggtgaccctccccatacctggagggatgcttgtcccctcctggccttcactgggtcccctcatgaccgtggcctcccaggacctcagcacaatcccggtcctgtgctccaggacaagccctccgtccccaagactgtgaggaaatggaacgaagaggggctcgctgcagcccagcacccacactgccccttctcaggggcaagaaccgtcctggaggacttggctttggagggggagcctgggaggccagtaagtcaacaagcctctactgctcatgggtgggatcccaccgcaggcccccacctgctggggcgggcagggacgggcggcacagcttggccagggcagataacccccaccttggccagggcgaaggcaggacacgtgggctccagcctggccccaccatccctgcacaacactgggcaaagtccacgttttcctcaactgggtgttgacatctgcaggacaggggcatggaggtacagagcgctgaagccacacagcaacctaggagcgagactccatgcctccccggggacccctccccaccatgaggaccatgaaggcttcccatgtgccgcaaggactctggtgtggagacacacgtctcctacacagccaggcctaacgctcttgtaactgggtggtcccacctgggctcacagctggagggccaggagctcaaggcttcgcagggtctgctctcatcccagaggcgatggggagccacagcaggctgcaggagagagggtgggccccctccacttcagaggccccatctggcccacagactggagagcacatctctcagcaaccacggagcgccaactgcgcacagggcctggtcgtcagagcggggcaaaggcactgaccgtcacggccagggcgagggaagacgggtgggcagggaccttgggcagagggggaagaacctggtgcccaggctggccctgccttcagcagtgaagctgagtggggaggcgctgatgcagggggccagaaagggctgctggtcagccgggaggagccccccacagaggaagcagccagcccagacgcagatggcagggtcccctcaacaatgtcctctgaaaaggagaggcggggactgctctggtgacacctacaaatagatagtcagccctcagccccctgccatacttctgacaaagcagaggcccccaggggaggcgcacccgaaggtacctgcacctgtcccccagactcctagagcccacctgaccccatcccaccagggctccagctacaaaataaatgccgaggccagctaggcaaggacgcacactcggtaccgactgaataggctccacgttgtcatgagcgcaacccacaggccaccaggccacactatgcagagctgagatggtttcggccaagcagcctctcagctgagctgaacaagtccagagtccccggggggtcgtcactatggagtaacaattgcgatgcgatggtaaccctaacagctaaccgtcactgagccaggccctgagctaggtacttttcaacgctgcctctctgcagcctcaggacgagcctgtgggagcataaagatcattccctatcacggatggggaaactgagctctgaagcagttaacgtgcttgtcccagaccgcagagctaggagcaggacacaacagcaggtcaggcaggaacgggtgaggggggcctgcatgggcttctctggaggctgcgcatacacgcaacccccaggaccccgaccctgcacctgcagctcgctactgccccctcagtgactccagcaaacctcggggtaggggaaggaggctgggaatacctcgggtgtccgaaacagcagcttctgcttggaggccactgctgcataatggttgctgcccagcacaccccaagccacctgtgccacctgtggtgaccttccagcatgccttggtgaccaagctggccttaggtgctgtgggcagccaagaatagaacagggcccacccctcctcttcacactaacacaaagcaagaggcgggcacttcgactgagtgcatccctctagctcaagggcctcacggatcacaggggtcagggcaagatcccaattctgcattcccgtctgcctttcatcctgctctgccaacaacagccagtgaggctggggacatccctgaacctgtttctcacctgaaacacatcataccattggaccccagccctccgggagaggccctaatccctgactgtggtgagatcagatcactggttaagtacccagaagggccttggtcaggggctccaggggtggggggtgatgggcgtggtggtatcccgctctgggctatagtccaccctgatggaggaggtctgtggtcagaaccgggctgtgcagggcacaggagcccagagggacccccagagctcacctggtggtctctgagcagggctccctcaaccctcagagaaaagcacagcaaggaggccgcccagagcccagcgcctagcacccagtggcgtgccagacctgcctggatcctggagatctctcatcaccctccaagtcagtcatgcccaacccagggacccacagcccacggggccgtgaaggtgtgctgagtccaagaaggccttcgacactgggaagccaagtggcacctcctggtgtggagcaggcggaatcccaccagcctctgctctgccagtgggcacagctggacgatgagcagaaggggctgttgcttaataaacgtcatttccttaagaggataaaacctttcaaaacagatggaaatttttttttaattaaaactggtggccaaagagatggaaagcaccccttgtgcctccctcccatcgtgacccatcctctgcacacctcaagctgttcgctgcccaggtgtctcctgaggcactgggggcgggtgagaatccgtgagccctcggccagccgtggctctctggagctctgccccaggccatcagggcacacgccgggcaccctgggggccacacagggcagagcccagctgggtcagcacacagggccacactgggcacacaagtctctgagcctcccctgtggacgcagctctcactatcccaccccactaggtcccggggatctgtcccacagggtgatatgctgtcacagaccactaccagagccatggcctgctgttccgcccgcagccaggtagtcacttgctccacagggacaggcaacgccgcacttgggggctgctctgcggcaggactagagctccagcagctcagccctcctgagaaggagaactccatgctctaagaggcagacgcagcggacggcaccaaagccaccacaagcccacggggccctgcatggcaggtcaggagtccctgaccactcgctctttgtaaccagagctgcagtggagtctacgaggcaaggactgtgggcggcagtggccacagcaaatgaatgagtgtcccaagggagcaggcggctgcggggaggcacagccgggacccaggagtcctccggcactgcagcaaactccctgggccccctgagcagcgaccaggtggcaagtgcatgaactcccgggggcataacctgggagggtgacactctcttcgtgttcaaattcttgagaacgcattaaaaatatcactcagtcacctactctatagttttaactcaaaagtaccaaagtagccaggcgcggtggctcacgcctataatcccagtactttgggaagctgaggcaagaggatcacttaagcccaggagttccaaatgaacctgggcaacatggagggaccccatttctacaaaaaaagtgttttaaaaaattacctgggcctggtggtgtgtgcctgtagtcccagctactcaggaggctgaggcgggagaaccacatgaacccaggggaggtagaggctgcagtaggctgtgatggcaccactgcactccagcctgggtaacagagtcagactctatctcaaaataaatttaaaaagcaccaagccaggcttggtggctcacacctgtaatcccagcactcagggaggctgaggcaagtggatcacctgagtcagaagttcgagaccagcccagccaacatggtgaaactccatctccactaaaaatacaaaaattacccaggcgtggtggcgggtgcctgtaatcccagctactcaggaagctgaggcaggagaactgcttgaacccaggaggcagaggttgcagtgagccaagactgtgctactgcactcaagcctgggagacagaacgagactccatctcaaaaaataaataaatcaatcaaaaccaccaagactttttaatataaacatttattattccataattccttttttgcatgattaaaaatgtttatataaagtttcctgaaaatggtaagaatgccaagtgaaggctgcaaatgcccaagcccccaccgtggcatctcacggagtctgggccctaggaggctggtgggtaccacgtggacccgagacttcacagtcaagtccctttggggtacactgggtttcccacaccccagaaatatgggctcttactgcaggaccatgggggtcctcacacttggcccagaagctgtcacatagccagacaggtgttctacaacctaggctagagggagctcatgctccagcagaattcgagccagaggaggtaaaagatgggtaagatctgctccctggacagatgaggccttggcctcagaacagttactgatcatctaccagacatcacactagaggcagaggggcgcagacgaagacagcccctgtcctcaaggccctcccaggttgggtggaccatggaaggttccagacagatctggcaagagaagtgcccacaccaggggcagaagatgggcaggtctgctcagggcggcacggcctgccaggccaaaaagttccaacttcagatgctggagaatgggcacgactgtctgagaaagggaaggatgtgatgaaaactacttggagaaaaattaatctggccagagcataagataaatgggcaaaggggaggttccagaaagcaaggagaccaagtaaaagctgatgtcattggctctgaatctaggctttcactgaatatgcaccgcagggcctgtaggtaaagcctcagagcccagggagtctgagtggaggagagggcaggggacagagctggggcctgtgtctacagtgctcaggaggaataggcatggacgtcagctcggaggctccagctgaagtgaggaggcggccagggcagcacggccacgcccggatccagactccttttgggaagcaagttcgctctgggggaaagtttggagaaatggcctttacccgcagaagcaagccccagaacatatcttgctccaaaactatctcgtacagtgaggacgttaagcttcaggtcccctagaggagacagtctgctccttcctggggcagaacccaaggtggccagagcctggaaggcacccagcacccaggctggtgtgttccagcccaggccacacgctcagatagctattaatgccccgttgagcaatttcctgagagctttgccaggcaggtaccgcctccccatctgaactaatacaggggtacatcccaaggaagaaatgaaaggtgcccacattttgctctgggattaactagggaggggagtgataattaactcagtaattatatttgccatcgggctaatgctaaaattagtgtgcattagaatttctttcctgagcagacaccggagtgagttgggcagcaggagtggctcgggcaagtcggcacaaagggcacctccagagccttccacaaatgtcagcaaaacccacaaatgtcaaggccggctccactgcacccagcagatgaattcacttccacagcctgagaccgccagctcatcggaggccatttaaaatccagccctctgacacctgctggatatcaccatttaccgtccccagatcaagagatcaaagggtggaacctgataggacggctctgaagttcaccacaaaagcataaacgtgcaagcagagccaatacgtcttttgaaaaggacaatgaggtgggaatttacataactgatcttaaaatatgttctgatgcttcagagatggagacagcagcattccggtacacaaagacactcacaggcagtggagcacagtgaagggtctggaatcaggacccaggtgtctgtggacactacacataaaagagcagcatttacaatgaatggataggatggaccatcccaccaaggtgttggacaactccctattcactggccagacccctacctcataccatatacaaaaaaaaaaaaaaaaaaaaaacccagacagaataatgtctgaatgtaaaacataaaacagtaacagtcctggaagaaaataatggaggatatatttataatctggagatggagtaacaagggataggaaaaaagccatagggaaaaagtagagttatgattatatgaagcttcttaatatctttatgataatgtaccaccagaaacaaggatgaaggactagctacagaccagcagtgaaacctgaaacaaacagaacaaagaattaaagtccataccaaataaagacctcccacaaatctataagaaaaagataaacaggctggcaccgtggcttatgtctgtaatcccagcactttgggaggcggagatgggtaggtcacttgaggtcaggagttcgagaccagcctggccaacatggtgaaaccctgtctctaccaaaaatacaaaaattagccaggcgtggtggcgcatgcctgtagtcccagctacttgggaggctgagccaggagaacagctggaacccgggaggcagaggttgcagtgaaccaagatggcaatcgcgccactgcactccagcctggaggacacagcgagactctgtctcaaaaaaaaaaaaaaaagaagaagaagaaaaaagaaaagaaaaagacaacagaaaaatgggccaaggataagtgtaggcaatttgcagaaaagtaaataccaataaaccagaaatgagggttgtgcaaatcaaaaggtgttataatttttaaccaaactggaccaaagaaaacaccaaaaaccaaaatcttgtaattgccagcatcagagaggatataggaaagtgtgtgttctcgtagatgcttgcaggtatgaactgctacagccttttaggagttatgtatgtatgtatgcttgtatgtatgtatttgagacagggtctcgctctgttgcccaggctagatctgttgcagtgctgtgatcatggcttactgcagccttgacctcctgagctcaatagattttcccacctcagcctttcaagtagctgagactacaggagtgtgcaatcatactcagctaattttttaaattttttgtagacatggggggtctcccaattttgcccaggctggtctcgaactcctggactcaagtgatcctcctgcctcaacctcccaaagtgctgggattacctggatgagccactgtgcccggcctcaatatctttaaaaacagaaatggacacactctttgactaggaatgtatcctataaaaacacttatacacatgcagagacacacgagcaagcatgctttgtaatagcaatgaaggctggaaaaactcctcaatcaggtaaatgctgtcaagtgcacctgtgtactatgaaatggcacttggcttttaacaagagcaaagacagaaaagcaaaagtacaaagtagggtgtgatggcacatgcctgcagtcccagctactcaggaggctgaggcaggaagatcctttgagcccaggagttggaggccaggagctgggcaatagtgagaaaaaataaaattaaataataataataataaaataggctgggcacagcggctcatgcctgtaatcccaacactttgggaggctgaggtgggaggatcgcttgatcccaggagttcaaggccagcctgggcagcaaagcaagacacccatctcaacgacaaattttaaaaaatcagccaggcaggctgggcatggtggctcacgcctgtaatcccagcactttgggaggccgaggcaggcagatcacttgaggtcaggagttcgagaccagcctggccaacgtggcaaaaccctgtctctactaaaaatacaaaaattagctgggcatggtggcagatgcctgtagtcccagctactgaggcacaagaatcgcttgaaccagggtggcagaagttacagtgagccgagatcgtgccaccgcactccatcctgggcgtgagtgagactcctgtctcaaaaaaaaaaaaaaaaaaaaaacaaggagccaggcacggtggggtgagggagggcacagaagcagcgcctcttctgggggcacccccaatctctagcgatccagaggcctcaggatcctgaagggagaaaaaacgtgaagctccgtgctagaagagaccatagagattggaatcagctggttctattttacaaaaaaaggaaactgaggccctcagaaggtgagtgcctctcaatgccccacagggaggcagggagagggctctgagccctgcagggccctggattcttgcaatggggtggagtggagcctgtgccgcccccaccaggcaccttctcaggagaggagccgttgtcatatccttgaaggggtccttgagcccctcaaaaggctaaaaaccactttcctccttgagtgaaccttcacctcagtttaaccacaagaaaaactacattaaggcccagcgcagtggctcatgtctgtaatcccagcactttgggaggctgaggtgggtggatcgcttgagcccaggagttcaagaccagcctgggcaacatagtgaaaccctgtctctacaaaaaacaacaaaatcagctgggcgtggtggtgcacacctgaggtcccaactacttgcgggctgaggtgagaggattgcttcagcccaggaggtagaggctgcagtaagcggtgactgaatcactgcactccagcctcagcaacagagcaagactcaaaaaaaaaaaaaaaagcaggccgggtgtggtggctcacgcctgtaatcccagcaccttgggaggccgagcgggaggatcaggagatggagaccatcctggctaacacggtgaaaccccgtctctactaaaaatgcaaaaaattagccgggcgtggtggcgggtgcctgtagttccagctactcaggaggctgaggcaggagaaaggcgtgaccctgggaggtggagcttgcagtgagctgagatcacaccgctgcactccagcctgggcgacagagcaagactccatctcaaaaaaaaaaaaattaaatctcaaaaaaaattacattaaggcaaactaaaagatgtttaaaatatatatattaaattaaatacactccaatagagcaaatacgaaaatacccagaaaacacaatccccgcacccccaggacaacctcccagggggtccacagcaagagaccccaagcacgagagacagagaacagtgtccctgtggcggaacctctggcccatcaggctctattagaaaataaggctcttgccactgagagaaagaggcacagtcgcccagcagccacgggctctggcacaccacgagtcaggccagcaaagtgtcaactgccccctacaaggtgacaaactaggacaaactggaaaccagaggctggacctggagcacagggaccaccacatggggctggggaatgggcagggacctcagagcgccacccacatgcctaagagcagcgcgtatgcgcatgcctctgcatggcttagggacacagggagctccccccacccccaacccaggaaggcagcccccactacccaggtagggaacggataggaccagcaccccgttctgctcgtaactcagggctccaggccccctcgggggcaaccagcacagagctcagaccccaaatatcttcacccacctcctggtccccatctggacaagggtgctggggactggctctcagtcacaccctcggggtactcttcaaaggacagctggatgccccagggcaggagcttttggcccccagctccctcaccccagacaccagctcttgggaccccaccagcatgggcaaggtggacaccatcgtcccgattttgcagatgaggaaactgaggctgagggctggcacacggctctccagagctgaagagaatgcagagagcagccggagccagccggtgggtccctgaggccggctcgtagcaagccacagctgcctccgcccatcacacttggacctcactggccccaggacagccctccagggcggcctggcacagagcccacaccctgctgcttcctgaacaaataagtgaacaaggccaccaagccgaggacctggatgtagccccggctcccgccagggcctccccaacagactccccatttggagagcgcattaagtgtttccaaagcctcacaaaccacagatgtccggctgtctcacggcttctgtaacctgaacttggccctcactctgccctcccagcactcctctcagggcccaggcccctcctctgagatgccagcactgactccccaacttgtccccatcacctggctcgttcctgaacctcggcaggagagtctcaggccagatcctcccaccagccacctccaccaggatgcaggaggcatgagacctgctcgtgccggctgggagatgcaaccaaccaagatcaatccaatcagcggatgaactgacaaatataatgtggtccctccacacaatggaatattattcagccacaaaaagggctgaaataggccgggcgtgatggctcacacctgtaatcccagcactttgggaggccgaggccggcagctcacttgaggtcaggagttcaagaccagcctggccaacatggtgaaatcccgtctctactaaaaatacaaaaattagctgggcgtggtggcgggcacctgtaatgcaagctacttgggagcctgaggcaggagaatcacttaaacccaggaggcagaagttgcagtgagccaagatcgcaccaccgcactccaacctgggcaacagagcaagactccatttcaaaaaaaaaataaaaggctgaaacacccatacgtggtactacttggatgactcctgaaaacgttacagtaaccaaggaagtcagccacgaagacgcattgtaagattcccttcatgcaaaatgcccagaacaggcagaaccacagaggcagaaagtcgactggtgttcaccaggggatccggggagagggaacgggaagtcaccgtgtaatgggtatgggttttattttggggtgatggaaatctcttataacttgatagaagagagggttgtaaacactgtgaatgtaccaaatgcctgccttctatactttaatattttatattatataagtttcacctcaatttaaaaaaaaaacaactcgacacctttcacctaggaaagatctggctttagcttgcatttcctgtaactcctgcctaaagccttccagaagcttccgctgccttgtggatcacaaccagactccacaccatgatctggcctctaagggcctctcgcaggacaccccgagggtgaaggagcacccgtgggcccacctctgcatagctgcaaagcttctttccctgtcctcccctctacatgggaagctctgcccgcaggggcggggccttatctgccattctatcgcactcaaccctagcacttcactcggtagcagacaccaaagcaaaacagcaacagcattataccgggccaggtgcacgttaactcactgaattcatggtaggaaggattctattcccattttacaggtgagaaaactgaggcacacaaaggtagcatcagcttcctaagcctcccagcacaggaagcggccaggctggaatcagaccctgggcgcaggggctctgtccacagtgctaactaactactcctgcccccgagggctgcagcggtgagtgagtgagtttgtcagtggactggatgtccaaggtcatacaggaaaaatccagactattgtaataacagcctctagaccggctggggccagaaagatcgaggacgctgacacacaactgcgctcactgcagctctgccagggatggggctaaaggtctcacacagggcagttagggctccccatagcctgggagaggaacggggtgagataacagaaactaggtatggtgcccgaagtcaaacagccactgagcatgtaaacccaggtgggtctgaccccaaacccctccacccccatcagccctgcaacccgtcgctgcaagggagaaagcaactcagaggcctcacctgcctacatcccccacccgtgtgtgtgagttctactaaatgcctgagcagtgacacagcacggctgaaattaaacgggttccaaaaacgacaggaagcacgaagtgaatctccccaggaaagtgctgaacaaatgctggatcgggttcaccggcgaatttcttggaactgaagaggggagctaaacacacggggccctgctttggaggggactctctcagggtgctccacacagcacttggttaaccccactcagcccttctgggctctcccagagggcccggccttggccttgggcatctacaggaggaacctccagggggagagggggtgcctggacaggccggccctggaacaagcacttgggccccgaggagagaggactagggcttgggagctggggaagttctcagcactgggaccactagaacaaagccatttccgtgcgttcacagcttccaattgcaacaggaagcaatcaggaaaaataattagcggcccacttactggcttcgctgaggtccgaggcatgtatttcacacagtaaaaccagggatataacatcaaaaccgttctgcagaaagattcctccctttccttccattttaggcctggatcaccacattcactggggctcccaggccttgctgcctaatgttaaaataatcaactctatttttgcctcacacacaactgaactctacagctataattctttctcctcaggggctcgaaccacatggacgacaggcatttgactccagcaacatcaccccaaaacgtgcacaaaacccaaaactgcaatgaggtgaaaggcaacgcggtcggcctagaaaccccccctttaaaacaaacagtttccccaaaaccccttttgcctccttgacccaggcatttccggaaaaaggagcggcgctggcctgtactccccagatactgtcgctgttttgtcttcaccttgttttgctagctccagacaaggccccacaatgtaaacacgctcctgaaagaggcagatttggggtgaaactgtccatagaatctctaggcttgggtcagaggcaggaggacgtgaaacaaactccaagctcctcctgttccccgctgtcccccacacctccaagcagaggctgcagcctgggggatctgactacagggccaccccgctgcaccattcacactggaaatattcagggagacagctgtttgccttaaggaggcccagacaaaggggcccgaggtcctccccgctaaactgccacaaacagaacaggagccgcggcgtgcacaggcacttgcggccgtgccacttggccagccatactccagaaaaacaaaacacgcacatccgaagagaatgatttaggtagcaagaggcttgcttgaaaaaccacatggcaatctccaaattaaaagaacatgtgtagcgtttcacgactgcttaagtttcctgagtcctcctgacctcaactccaccccctgggaaacaccaaaagttggatgagaaagttcccccgccctacctctccccacgggagtgtacaactgaggcacaagcctgcctcccccactgccccgcgatctgggaccacgtctcctccgcgtagccgacccggggatggacactatctggggacccggcggccacacggggcattcgggtcgcccgggcacctggcaggtgtcagtccgcttggaaacccacagccacgcggctcacaggagcagcgccaccggctaggccgccccgcgcccgggctcagaactttctcgctgccacttcagcccgtcctcggagcacgcggggcggccgcgcggccgctggaaacaggcttgcgaaccggctccccgggccaggcccgcctccgcgccccaagtccccgctcggtgcccggcccgggccacacgggcccagcgcgggctcggctcggctcccggcttcccgcgggctcgggcaggtgaggacccgcccgcgccgcacctggcggagcgggcgccctcctcgccagcccgggacgcagcgtccccggggagggcccgggtggggagacaaagggcccgcgcgtggcggggacgccggggacggcagggggatcccgggcgcgcgccccaactcgctcccaactcgccaagtcgcttccgagacggcggcggcgcccgcgcacttggccgcggggccgcccgggccattgtccgagcaacccgcggcccgtcttacacgccgggcgcgggaaggtatcgaatcagg

SEQ ID NO: 8 - DNA, 33769 bp, Homo sapiens
  unsure (33739),(33749),(33758): Identity of nucleotide sequences at the above locations are unknown.
cttccccttacactggtccttcgacccgcctcggatgaaaactgaatgggtttagccttagaggctctcggtctctaagggaggtgggtcaggatgccggggacagggtcctcttcctggggcaacgtgggggaacgagccacctacccctccactgaattgccctggggtgtgggtaccgacggctcattcggtgtccagggtctgagatgtgttgacaggaagaatgaaaggggatgggagggatggggcgaaagaagccacctgcagccccaggaactatctggccagcacaccgtcacccagcggcctgagccacccctgccagagccaggaggagaccctgccaatgggtcaccagtgtgcaggaactcagaaggtcatcacagttaataccctccatgccccaatgtgggaaaacaggttttttcacaacaaacaagataatttttgttattttggcaaaaggaggcagggcagccccggacacctccatcccacctcatcacccagccgcagggccccggccatccctgcagacagagtggatgtcacaacctccctgcaccgaaccaagtgcagctcccaggccacaggccacccaggaaaggtccagtggcccccggaggctcccaccgcaggcctcccaccacagccggcaccaacccaggatagctgtgttctcctggcttcttttcacacgggtagcagaaagctgagatccggggaaagctgagatccagggaaagctgagaatcggcctctgctgcccggacgcccacccccagctctgctcccagctccagggcctccttctcaggtgcccttacaggaggcagagggcttgagccacctcctgggcctggggcacgcaggatgaacggggtcacggtgcaggccactgtccactgcgcagatcccaaggccataaacagcctggccacagtggcttcccagctggcaggcggccagattatttttgttgtttagcaattgattaagtttctccgctgcccccaggggtaagtggtggggcaaatgccgcaaccgcagcatttgacccgggatcctgtgccaagtgaccatagggtcacaaagcacaagggaagtggctgggcccgatgctggctctgctggaacctgaggccggccactgtcacctgcacggtgcctgggaccttccagcaagcacagagaagctatggccctccaggagcagctggcaggcaccttggcctgcagtcaggggctctgtctgctcagctctaaaacaggaaagtcgctgctctgcctggggtcagggcagccagagagtgaccaagtcagtgccggcctcaggaagggacctgcaggcgggtcccttcctctcccatccctcggtgccagccagcccctcctgtggccccccactgcctgcctctgcccccatgccccaccacaacctcaggcccatggctgcatggccactccccaggcaggcagtggggatgggatttcaccatgttggccaggctggtctcgaactcctgacctcaggtgaggagttcctaaagtgctgggattacaggcgtgagccaccgcgccagccctccctgtggtactaaacactcacacccccttgctggggaccctggtgagggaacacagcctcacaagtgaagtgtggttttgttgagcaaatgacgcctgggcagccctctcatctttgcctaaaactgaagaatttaggggcgtggatgtataaaacagttggtgacttaaatgaaaaagaaggccacactcccccctttaggcaggcggcctaattctttaaaagccagcacagggtgcctttctgaacccaggcacacagtaggtgttcaatggacagcagcggttacttgtactgctcatgacaccctgtctgtggcctctgcagctggctccagcctgacgcatggctgcgcccctccgcaaggccaccccggtatacatggaaactctgtggagaaggccttgggggccggccaggacgccaggcccagatcccatctgcgcccttcctccatagacctcagcgagctctcggcaccatgtgcctcaggcccatttaagaagtagggccggccaggcatggtggctcatgcctgtaatcccagcactttgggaggcccaaggtgggtggatcacgagatggtcaggagatcgagaccatcctggctaacacggtgaaaccccatctctactaaaaatacaaaaaataagccgagtgtggtggcgggtgcctatagtccaagctactcgggaggctgaggcaggataatcgcttgagctcagcaggcagaggttgcagttagcggagatcgcgccattgcactccagcctaggtgacagagagagactctgtctcaattaaaaaaaaaaaaaataaaaaaaagaagcagggccagccacggacgacccctcacacagctcccaggacgcgtgcctgggtatagggctcaggaccatgaccgctgcagtggcccccaagaaacgttacttttgtcacccaccccgcctcagtggcagtagccaaaataacggattagaatggaaccatgtgacaatgccactgccccaactgacagaagatggctatcagcagttcacgcggccccacctatcacaagtgcagggcactctacaacttatgcatccttccccagacaccgtcctttcgaccctcccaggtcagcaaggcacacagggcctacatttcacagccacacagcagagggctgaggctggaactcggatgctctgatttccgttcaatcacatccccagaggtggcacagagacggggggcttctcttgacaaagtcaagaaagtcactgccagctccactgaagaccaaagaacctcagctctcaaaccctcttgaaggtgttaccgaactctcccagcctgtttcctgggtcccgatgttggtcccgtgggacacaggaagaggaagaagctccctagagcagagcctggtgcacctgccacactctcagagggctgcgcacgggcggaggagccgtgtgcaggagtggggtctggatggaggggcgctgtggccgggggcagggggcaggggaagggtgctccaggtggtgggcacagcacgagcaggggcagggaggtccacactcagatgtgcacagggagaaacaaatcgtgcatttccattggaataggcggtaaaaggtagaaaaacagagtgggggccaggaagggagtcggagccttctagtgtctctctgcaggtgagcggcagcccgaggtgtcagctcagcagacttggggtccaggggccgtgtcttctatcactgaccccagggcacacggaactggggagggagagcagaggcacagggcacggtcagtgaaacgaaacaaggagtcatcaccaaatgcggaaagggcaaggagtgcccgcagccgcacaagggttctgtctgggcaacgtgggcgtcccaccaggccccgcaccctgcaagcgcaaagctcgccactgaagataaagggaagctgttggagctgcggagctggtctggggtccgcatggagctgggcttatgctgcagtcacaagggggacatggaagaggctgcaggggacaaaaccagtgaccacagtctaactctgagcctgtggaaaggcgcccacagcattcacccatcccagagatgccattccccctgtgcccccgctccacggtgacagcgttctccaggaatatgatgcgcccctctcctcttgcatcagccctgacagtgagtattcaggccaaaaagcagaagagcacagctgcgtggttccatttccatgtagttctggaacaggcaacgctaatccaaggtgatagaagtcaggagagtggtggagggggcgggggttgaggatggcaaaggggcaccgggaactttcccagtggtagaaatgttctctgtctggaccgtgtggtagttatgcagacatatgcagctgtcaaagttaatccaaatgtacacgttaaaatgtgtgcgttttattgcctgcaagttatacctcaattaaaaaaataaagttagcactcaggcttcttccacaacttcctgaaccgtgtgagctgattttcttgctattaaaaattcacggtccatggctgagaacagcagctgccttctgtttgcaaagtcaacgccaatcactgcccggccgcggcagactcggccccacaggacctcctttcttttttccctttgacctacttccctgataagtgacaagacagccagactctgggaacaaacgcccgttattcggccccgagctgagcgggccctgcttcctgagctaatccgcccggacagacggagggacgtgaggggctttgccgtcggctccagctgtcagtctgcccgtcagactcgacagtggccccctctgttcctcccgctgcccccactccatccccgacttctttttgtttcctgtccctgacagacgaacatctgttaaaactctgtctgggtgagctgtggccagcggcccacaaatccccaagccgcaccccagcctcatctgggcgctgccgggagcactgcctggccaccctctggacatagctctgagagccaccggccagggcacgtgtggcccgagtggcatggtgcacgccgctaagcccactgcccaaaggcccccaagcaggagggatgtgcaggagacaaaagtcaaaagaacaggggcacgttccacagaggatggggctggaggggtggcagtgaggaacagcagcttccgaggatggcggtggcaactcccaaataaggcctcactcctgctgtttttagctcattccacataattggaaaaacatggcagaaaccgaagccagctgctgccttggtcctggggctgtgtggagggggtggggaggccggaggcccaggctctgcactcgactgctggggatgagagtgactctgagctgcagagagcagcatcgcagccgccatggtcccattgagccccggccacgctgggcggcagaggctcgtgggatatacctgccctgtctcatgggggtcacttcaggaggggcgggggagccaggacacagcccagggctagcggtcaccctgcagctcaggggccacgtaaatagtgccaccttgaaggcacacagcagtgcggggccccccccgccaccaacgcatccctacctctaggaggccgcctgtgtgcccctgggaacgctgctccctgtcccttggggtcctggtgtgaccaccctctcagccccttccttggggaaggcacctgactccctacacccagctggctttcatttgctcaaaatcaggaaaaagcagaattcaagacatcacagaaatgtcttcgcctgtaactccatgaaagataaacggtcagacacccaggagggagtcccagggacccttgagtctcacctgaggctctggcttcaaacctcgagatgtttccagccatgctagcgccgccccccacaacctgccccacacagtcctcccttgggaactcacagatttggcccccacctgccccgtttcttctggtggagtgggtgcgttgggttggggtggggctggggactctggatgtgtcttaagagtctgagtgattctgacacagccaggccctgcccccctcctgaccttcgccccacaggaaagggagccacacgcctgaagcgcccagcacacccccctccgtcctccccaggtcacccgctggccgtgtgagccgtgctccccactgccccttcacccaccccagctcctcctggcagcacccagccttggaagctacttctgattacaaccgccgaaggaagactcgctccctcggcactgacccagacagcctgcaccatcacgctgctcagcacaacccacacagccttcctccaaaccccatggagcggggagtataatcaccccctttctaccaacggacaaactgaagcacagagaggttaagtcactttcctaagctcccaacacgatgacaaaaaatagaaggtcagcccgcaagtggaactaggtgctccaagtccccggtctgcctgacactgcacctcctcgccgccacggtcccgggtccgcctgacactgcacctcctcgccgccacggtcccgggtccgcctgacactgcacctcctcgccgccacggtcccgggtccgcctgacactgcacctcctcgccgccacggtcccgggtccgcctgacactgcacctcctcgccgccacggtcccgggtccgcctgacactgcacctcctcgccgccacggtcccgggtccgcctgacactgcacctcctcgccgccacggtcccgggtctgcctgacactgcacctcctcaacaccaccacggtcccgggtctgcctgacactgcacctcctcaccaccaccacagtcccgggtctgcctgacactgcatttcctcatcaccacagtcccgggtctgcctgacactgcatttcctcatcaccacggtcccgggtctgcctgacactgcacctcctcaccgccacggtcccgggtctgcctgacactgcactttctcaacaccactccttggccggctcccaactacaaaccaagccatgtcttccatcctgaatcctcttggcctaaacatcactcacaatgcctccctcgggaacaggcacaagtcccaccagcacagcctccttcgttacctgcgtttccgctagcccagggccagctccagagccctcaccacagagcctctatccttcacccccggacactggacctcaccaacccatagcctggaggagatccctgtgtgaccccagggcctcctctgcccgactctgaatttcactgcccaacgtgacacctcggaaggctctctgggcactggcagccctccatgggcaccgctccttctggccagctctgacatcccggctggtgaggtgccctgcacgaggcctctgcccactgggacctcacagccgtgctgtcagctgcaacaagcgacagaatttcacgttttcttcacgttgcccctgggtgagcagctccaggtagttttcagtcgaggcgaggcgtcccgtcagcagccaggcggcacagctaattcatgcccgccgggcgcacggccgcaataccaatgggcacctgcagcctggaaagccacagaggaaccgagaacagcgactgtgctcaggtgacaggactgtggtcttttaacaaaacattttcctttaacgtgatattttacggcaaggaatgaaacctggagggcaggacatttggatactaaagccccaggctgccgcgtggtctgctttgtgaagtctgaagcccgcgccccattctggccccgctcacaggtccggctctgactcaccagcttcaatgctaggccgtgcctgtcctccaaccagaacatgacttccttaaggacaaagccgtttctcgcccatccccatctccctctggattaagaaatatgggaagatcttctagaaccacctcaaatttgcagagagccatcctggtgacaaacccttgaaatgcttctaagaagagtttaggtttcttctcaactctaaaacctctagaaaactctatttccacaccagctgcccctggaacacttcagcttcaaaagggcccagggcagggagacggaggagccagcatccacaccgagcaccagcctgttaattaacgggaagcgggtggggcccatctccaggcagctctgaggtcagactggggaaccatgcttacaaaaaaaagtgaactgaaacgctcacgtcctcatgcaaaaccagactcccagttgcatctttctgtctcattgaggagctttttcctccctttgacagaacaccctacacacggcatctggaaccaaagcagaaagattcaggctcagagtaaaacagtccccacactggctgcatgtggacgttcccggcccagagtctcgcccaagcagggcctataaatgacacaaaatgtttttctcctgcgtgccagtcatgctccaactgagttatgtgtaaaagtgcctctcacggctgagggcaaaaacagttcccacaagactagagaaaggtgacccctgacggctgagtctctagggagcgtggagctgcgtgctcagccctgcggccctgacggctctggaatggaaaagctatccaactggaagggcagggctcgctgctagtccagcggtccaaccccacaggtgtctgtggtgtcagctccatgccacagagcccagggctggggccagagccaccaggccccctgccagcctgcaggggcctcctcctctgggtagcctaaccaccccctgtgagcgcaggcagcctcctctaatcaccacagggcctgtccccccctctcccccgcttgcaggaaaatgagccctgaggactccccagggctgctctgggcctggacatggagactgggaattacatttgcagaaggagcgcaatgcccttgaagggctcagccacgagcagccagtccccagggctcagaaggcccagctgttagaaccctgggagccagcaaagagccaggggctccacctaagtctatagcccctgcctcttctggttgggaaagaaatcaacgcccctttactggctcccactgacagcccactcccccaggtatgggaggattctgggacgatgcaggcaaacctggaccctgagtgaacctgccccagctctcacgggcctggcaccagccacagcacctaaggcgccggtcatggtgacaacatgaaggtgataagggcatggacagtggacatggcagctggacactgggcacccactggatgccaggcacccagcacggctccgtcacccctggatgagcagtggccctttgcaagccagggtagcctgggcaagttatttgggggtctccaagcttgtccagctgtgcgacttcactgagccatgagtctgggattttatcagggcccacacccgttcctggaactctgatacgtgagggagccacacagggacccttaacaaaagctcccagggcaacatgttctcttgcctcagtctcccaaatagctgggattacaggcgcacgactaccgcccggctaatttttgtatttttagtagagacagggtttcaccatgttggccaggctggtcttgaacccctgacctcaaatgatccttccactgttagggcaaggcacctgacaggcacgactgcacgatctgcttgttgggggctgtgtccattccccactccttcgacaaatgtccacacccagccttgctttgacaccccaagaacagagatggtgacacctgcttcctacatgcccattgctctcccaaggcagacatccccagcagatgcaacacagtgtttaggcagacatcaccaatcgatggtggcaacagacaccaggccctgctccctctaactccagtggccaggccccaagccagctctcacctgcccactcccaacccacagcagcaagactcagaaatggcaaaaacacaaagagaacagaaacgccccatagcgggaggatgactaaaagacatgtcttgataagatattgttcaggcataggccaggcacagtggctcatgcctgtgatcctagaactttaggaggctgaggtaggtggatcacctgaggttaggagttcaagaccagcctagccaacatggtgaaaccccatctctactaaacatacaaaaattagccagacatagtagcgggcgcctgtaatcccagctgcttgggaggctgaggcaggagaattgcttgaacctgggaggtggaagctgctgtgagccactgtactccaacctggacaacagagcaagactctgtctcaaaaaaaaaaaaaaaaaaagatatccttcactaaaactcatgtctttgatacatatttacctcctgcaatcgcaaatgcttctgcagtgcataaagtgaaataaatagcaggaagccttacggttcgatcacccacacagacacacagtcacatacaggaaaaacgcagggagggctggggaacaaaaaaacagaagataaaatgtggagacagacacaccaagagagtaagagaccacctccagacctcccttcagcttctcaaacacacgagccgggcccgttacagaatttgcggggaccgctgcaaaatggaagtgcagacagccccttactcaaaaggtaggaatttcaggtcaacaacagagctcacctcatatgactacacaggtcacacagcccgtgaagtcggtcccaacaccagcatgctcctgcctcaaagccgctgcacgtgctgttccttctcgcctttccctcttttagtccttcagatctcaggcctcctgagagagacctctgacctgccggctcaggcggccacacccccagtacaggagtctccggctcagcccctgctgtgttccgtacccgatccaggtctgtcctatgtccatctgtgtgccggcttgcttcctgacatggcccccaccacacgtgtgcctcggggcaggggaacaggcccgtctcattaactgctttcttctcagatattttctggaatatttgtggatattgggcaacatatatgctccacctttttcagactagccaggacgagctgcatttttttttttttttttttgagacagggtctcactctgttgcccaggctggagtatagcggcatgatcttggctcagtgcaacctccgcctcctaggctcaagcaattctcctgcctcagtctcccaagtagctgggattacaggcccgtgccactactgcccagctaatttttatatttttagtagagatggagtttcaccatgttggccaggctggtcttgaactcctgacctcaaatgatccacctgccttggactcccaaattgttgggattacaggcgtgagccactgcgcccggcccgagctgcctgttttacacctttgccatattccggtgattctctctcccctccgtcccccggccctgactgtggtggccactccctgccgtcatgagcccgtatgtcctcactctttccctttccgccaggacttcaaccaacactgcagagcgcagggtccagctccagcactgagttcagcctcttctcaccaacagacaggcaggaaagaaaacaaactctgagaaggccaaggttcccgggcagccagcaagccaagcatccttctccgctgaggcttgtgcagccgaggcaccccctcctccagggagcaggcagcgtcctggggcagtctgcgagggagaccagggcccttgctccaccagggccccaggtatgggggcagcagcaaactcatggctctgggagccagaccccacctgctagaacctactatgccacctgctgtgggcaaccccaggctggtgacttgccctggcctcctctgtaaacaaagggctcatccaacctggtcaaaccactcctccccttcaagggtctataatcctcccttaacctgcttggtccaaacccctggtgtcgccaggtcactcaggaggcagctcatctggactccttccctgggtccagtttctctctcaacattgcctttgaggccgaggtgaacggtcaacagcgaagggccccagaggtgatggaggagcgggtgtccaagacactcaccctttctaatgcactgactccctcgtggactcacttgtgccgtctcccccacccacccagccccagagcccagagtgcgagcgccagaggcccgggattctgtctgcaccgcggggtccccagtgcctcggagcaatgccagcacccggcaagtgttcgacaaatgcctgctgaatgagcaaatggatggatgaacgaatgaatgagcaagcagatgaatgaatggggtgctgtccagagccgtgaggactaggccgcccaagtccccatttctcaaattctccttctcccgacttgggaaacaagatgcttggtcggggaggctctccaaccatcccctgcagcagccggcacagcggacagaccctttgatgtaacagccatgtcttcattaaagatgccctgctctcagaaagagaaagacaaatacaaacctggaaaatcctcaccaaacgcaggacccctgccagggagcagagaaaagacccacacgccacgggcgccacgaccacacacacaccccagccgctgcacacaaacacagaccctagccagcaagaacagggggaccaggaaactgttcctaaagtcaggacccccatgtgctcagacagcagtgagagcaaggacacttctccatccaccggatgccaggagagtccttttagggggccccacaccgagactctgcccttaggactgttcctgagtgtggaagccagcccacttggaagccccctgccctcccgagtgggacaccggcacaggaagcaggccctgtcccccaccactttctgcaagctgggccccatcacgctacagaaacggggaggactggtcccagggatggcgctttcctgacacctctcgttaccccctcgcttgccaggccccagggtcagccccagaggccagactggctatcccaggcccgggagcatccccgaaggcgagctgcatcctgaacgtgtgtgatttcccgaagggcccgccccgaaccgacacctggaaagaaagatcctcagccggtgccccagaggagaagagccatgcctcactgcaacacagtcccaggaagcaccaagtgcctgaggaccaaggcggagagtaaaaaagtggaaaatatctggggcaaaaataaaacaaaacaaaacaggattgacctcctgggctcaagcaatcctcccaactcagcttcccgagtagctgggaccacagacttgaatcaccacacccgccaagtggatcatttcgaacgggtttgccgaggttccttctggggcacccccggcggccgcaacccattcccgccaggccccgccccgcccgcccgccccgtcccgtcccaccgcctcacctgccttacacgtcctgccgttgtcctgcagctgcacacccgtggggcaggcgcatgtgtagaaaggctcgcttggggacagcaggcacaggtgggagcagccgccattgtcctcctcacagcgagtgtggactgagaaaaccaggacagactgagagaaggttccagaagaggaccgtcacttgtttctgaatgagtcacatcctgcctcgtcccccgtgacagcctccagtgtgtccctctgcccaaacatcggcctcaagtggcatcagggacctccccgcgggcaccattccacctgcctcatcgctggccccgtccacatggggccctcagcctggccagacggcctgcaatttccccaaaaccagccgtgaccttcctggccaccctcacacccagatgtgacctgcccatggagtgacatcctccccatctgcttcctcccaccaagctcctatgactagaacaccctccccagctcctcggagcccccaaaggacacccctctgcaaaggctgccccccacgctccaatggccggggtcaggacctgcctgtgtggtagtgacgggaaccccagagacaatgggctcctgggcaaaaggcttgtcttgtctttgtgctatgtgtggacccagcagcttccataggaacactgtccttcttgctgggatggccaagcttgtcactctcccaagccctcctatgaccaacagcaattgaacggaactcgataaatgcttccagcacctcattcaaaccaggggaaagctgggtgtagcagccccaaaatacggatataactggaacaacaaactcatcaaaatgaacctctccctccctcatgctgccccaagtgtagatgggttttgtgaccacgactttctcaccaggaaacagctccagagagccccaccctcctgtgtcctgctctgggaacagctggcacccctaggccccacatttcaattcaaagtccaaaccttccataatggcctggccagaaatctccatccctggtccctgtgggagtgggccactgtccccagagccgcagccccactgtcacagaagctggtgcatttccccatcagggacctctgtcacaacccagcgtggcccccaggctgagaactgctgattctgggcagattattcattgataaatacgcgacttgcagggccaagcatggtggctcatacctgtgaccccagcactttgggaagtcaaggtgtgaggatcactggagcccacgagtttgagacaagcctgggcaacgtggcaaaatctctcatctctattaaaaatacatacacacacacacacacacacacacacacacatatatatgtatatataaataaccatatatatatatacacacatacgtgtatgtgtatataaatacatatacacacacacacagacaacttcttctgggccttgaaaacgaggcaaccttccttggaaatccccttgccactgctgagcctgaaatagcccccatgagctctgcagaggggtcctctgcaggcccgtgtcccccagccagccacacacctccctccattgcagcaggtacccctttagagagggggccccccagagcatgggcttctgcagggaggggtcacctgcccccccaccccacccacgcccgcgcacccccacgcccccgcatcctcccactcccctgccccgcgcccccgctccccccagccccctcaccctctcccccgtgccccaaccggcactcacaaaaaggctgccgctcctggctcagcacctggatgtccatgggtgagtatagggcactcaggatctccttcctcttccccccagtgcgcttgttgcaggcatggatggagcgggtctgccagtctgtccagtacagagtgtccccggagagcgtcagggcgaaggggtgcgtcaggctgccctccaccaccttctgcctgcagtcagggaagcggggtggaggagccatcaggagggtcccccgacagtcattgctgctgacccaattaatttctttttttttttttgagatggagtctcggtctgtcgcccaggctggagtgcagtgatgtaatctcagctcactgcaacctccgcctcccgggttcaagcaattatcctgcctcagcctcccgagtagctgggatcactgatgcccaccactacgcccagatgatttttgtatttttagtagagacagggtttcatcatgttggcaaggctggtctcgaactcctgacctcaggtgatccacccacctcagcctctcaaagcgctgggattacaggcgtgcgccaccatgccaggcttcccatttgctttcaaccagacaagtgaggccaggtcaagagccccaggagctggcgccctcgtacatttctcccggcgtgcacagggcacctcccaaacacagcctgtgatggtgacacacgggctcccccaggtcaagtggcaaagtctcccccagggaagaaaggaggaagccatgcctggcaaaaagcacacctctcctgcccaacgctttaacctctgtatacaaatcaggccatgtgcactcgctccttcttacaatgctcataatttatactttcagagtaaatgaaacttggcatcaacccgagaaacagctattcttttctagatgcttacagtgcccagcaaatgaggactcgggtgtaatgagattatggacactggaaacaggatcataatgtgacgtggtcggtaatgtgcagttttatttgcttaatgaccctcgccccgtgacaggctccctgagggtgggcctgggggcagaggtccccgccacgtccccagccctcagcacagttgccaggagagggtgacactcatgaagtggcacagggaagatgggagctgtgggctctgcagatccaccacctcttctgttcatttttgttgatgctgttttttaagaaaattattgaagtaaaattcacaggacatacgtttacttttttttttttttttggagatggggtctcactctgtcacccaggttggagtgcagtggtgtgatctcagctcactgcaacctctgcctcccaggttcaagcgattctcccacctccgcctccagagtagctgggaccacaggcgtgcaccaccacacccagctaatttttggggggtatctttttggtagagacagggtttcgccatgttgcccaaggctggtcttgaagccctgagctcaggcgatccacccgccttggcctctcaaagtgctgggattacaggcataagccactgcacccagcctaaatttaccactttaaagtgaatagtgttacctagtgcattcgcaaggcggtgcagcctccacttctgtctagttccaaagcacttccattgccccacaggcaaaccccacacccggcagcagtcatgccccagtccccgcccccagccccggcaaacacttttgatggacttaactacacacattctcaacatctcatataaacggaatcacaatatacagcctctgatgtctgtcttctttgacttggcaccatgttttcgaggttcatccaggctgtagcatgtcagtgcttcatcccgttttaggggtgaaccatattccagtgtgcagacagaaaccaatctgtgcatccattcacccactgggggacctttgtgtcatttccaccctcggctgttgtgcacagtgctgctacggacattactgtccattcacattttgtgtgaagacctgttttcgattcttaagagtatacagctaggagcggaattgctgggtcatacgtaaatcaatgtttacgtctcaaggaatcaacaaactgttttccacaatgttgtcttttttgtttgttttctgagacagggtcttgctctgtcacccaggctggagtgcggtggtgtgatcatggctcactgcagcctcaatctcctaagctcaatccatcctcctgcctcagcctcctgagtagctgggaacacaggtatgtaccaccatggccagctaattttctaattttatttttttttgtttttgtttttttgagacagagtctcgctctgtcgcccaggctggagtgcagtggtgccatctcagctcactgcaagctctgcctcccgggttcacaccattctcctgcctcagcctcccgagtggctgggactatagtcaccggccaccacgcctggctaatttttttgtatttttagtagagatggggtttcaccgtgttacccaggatggtctcgatctcctaacttcatgatccacctgccttggcctcccaaagttctgggattacaggcgtgagccaccacgcccgaccttacttttaattttttaattttattattttattttattttttttttttttgagacagagtctcgctctgtagcccaggctggagtgcagtggcgggatctcagctcactgcaagctccacctcccaggttcacgccattctcctgcctcagcctcccgagtagctgggactacaggtgcccaccacgatgcccggctaattttttgtatttttagtagagacagggtttcactgtgttagccaggatgatctcaatctcctgacctcgtgatccgcccgtctcagcctcccaaagtgctgggattacaggcgtgagccaccgcgcccagccttttttttttttttttttttttttttgagatagagtcttgctctgtcgcccaggctggagtgcagtggcgggatctcagctcactgcaagctccgcctcccaggttcacgccattctcctgcctcagcctcccgagtagctgggactacaggcacccaccaccacacctggctaatgttttgtatttttagtagagacgaggtttcaccgtgttagccaggatggtctcgatctcctgacctcgtaatccgcccgcctcggcctcccaaagtgctgggattacacgcgtaagccatggcgcccagcccatgtggccatttttcagtgagagaagccagaggcccatcactctcggttgctccctgggccatgctctgcctcagccagaagcactgagggaaggtcagcctcggcccttgccccagccacagtcacagataaaggggcctgcacaggtctgtgtggctccagagctcgtcacccaacacacgacgcttccatgtgaatagccccaggtgcatcatgaagagcgatggccgctgcagaggcagaagaatcccgcggggaagcaggtgggagagaggctgagaacagaccagaccctggagctacagaccctatgttccaaccctggctgggactagctgtgtggctctgggcaaattcacatgcttctctgtgcacaggggatcaaaatagcaaacacaggctaggcacagtggttcacacctataatcccagtgctttgagaggccgaggtggacacatggcttaagctcaggagtttgagaccagcctgggcaacatggtgaaacctcgtctctacaaaaaaaataccaaataaattagccaggcgtggtggtacgtgcctgtggtctcagctacttggaaggctgaggcgggaggaacacttgagcccaagaagtcaaggctgtggccgcgtgtggtggctcacgcctgtaatcccagcactttgagaggctcaggtgggtggatcacttgtgatcaggagttcaagaccagcctggccaacatggtgaaaccccgtccctactaaaaaaatacaacaatttgccaggcgtggtggcgggcacctgtaatcccagctacttgggaggctgaggcaggagaatagttagaacttgggaggtggaggttgtagttagccaagatggtgccgctgcactccagccagggggacagagcaagactccatcccaaaaaaaaaaaaaacaaacaaacaaacaaaaaaagaggtcaaggctgcagtgaaccatgattgtgccaatgcactccagcctgggtgacaaagtgagaccctgcctcaaaacaataaaaatataaataaaaataaaacataatagcaaacgtttcatagaggtggtatgagcattaaatgaactgataaacgtccctggaaaacagtaagtgctatggaaggattcgctgccgccaccgccaccaccattagcatgtttcaacctccatcaccctcactgtcccctgtcaccatcctttgaccagggcactcccagctgcagcctttctatcctcttgtccacccttcataactgtaagatcactcagctcccaagaaccacagtctacagggtaaccacatttccaaatctcaaaccagacccgctggtctgcacttccagggacaacaggatattttcaaaccagcccaaaagagatgtgtggctcagcataagaggaacaggagaaactgaggcctcttgccctgagaatgagcttggaagtggatgtcccggcctcactcaaaccttcagatgactgaggcccagccaggagcttgagtgtaccctcaggtcataccctgagccagaagcacccagctaatccactcctcatcactgactccctccccataaaaaacctgtttgctgtttcaggctgttaagttgtgggctgttttgttacacagcaatggataactaacacacgaggcctggcaagtgtggagcaaagctgcccaagccctcaagtctgttcatgtgggtgttggcctgtgtttgcagaaatccagccactgagtcctcccatgcagtcactactgccctctgcacagacacctgccacatccctgcctgggccaggagctccactagtgcaggaatggggtctgccgtcccaggaggatccctgacacctagcacagggctagcagcaggcagcacttggttagtgaataaactgcccttcacctgtacacagaagggatgtttctataaggggtaattaagtacagagctgggaagctatgctgaccagaaggctctaaaagcaattaaccaacgaggggaaaacccttcctactcattctcggcccattttattgagcactgaccatgtggaaggccccctggtgagactggggaatgcaccaataactgagacagcttccggctgttgccctcaggatgcctgagctgggatagggccagggtgggggtggtgcgtgtgacagggttactgttcacaaccctgccgggccataagccctccccaacaattccaaaatccaaaacgctctgaagatggaaagcttttgttgctcatctggtgacaaaacctcatttggtgcatgggccgggtgcggtggctcacgcctgtaatcccagcactctgggagccgaggggaaggatcccttgagcttaggagtttgagaccagcctgagcaacatgtgagaccccgtctctaccaaaaatacaaaaattagccaggtgtggtggcgcactcctgtagtcccagctactcgggaggctgaggcgggaggatcgcttgagcctgggaggtgggggctgcagtgagctgagattatgacattgcactccagcctgggtgaaagagtgagactctgtctcaaaaaaacaaagttaaaaaaaaaaaaactgtgcatgggtgtgggctacagatagtcttttctgccctacttagaatgaacgtgccacatttgctatagaaatattcaagggctggtggcaaatgccacacagaccctgacgctgttccaagttctgagaagtcctgcattcctcagggccccagagtttcagagaagagtctgtaggcctgagttaagaaggaacgccttcaaaagccctggggacaaaggggaaaggggtgccccaggactgcgtgggtacctaccggaacgagccgtccaggttggcacggtggatgaagctgagcttggcgtcagcccagtagagcttctgctcctccaggtcgatggtcagtccattgggccagtaaatgtccgagtccacaatgatcttccgggtgctgccatccatccctgcccgctcaatccggggcgtctcaccccagtctgtccagtacatgtacctgtgacgggggcagggcaagagaagcagctaacacagatctgttttttgtttttgtctgcatagatgcagacatgaaacaacagacagtgaacttgccctaaaatctcacccatcggaaataaccaacaggtatggtttcaggtattcctgccttaagctgggcaatcaaaatatactatttccaacttgttctcagttaacagtaaattctgggcaccttcccttcttgtggatagaaagattccttgttcttttgatgattgcctagtgtactctgctgtaagttttttaaagaacttcaggttatttctgatttttttgctaccatgaaaatgctgtaaatgaacctctaaaaggcaattcaaaacactcaggatggaatattatttagtggtataaagaaatgagctatcggctgggcccagtggctcacacctctaatcccagcactttgggaggccaaggcgggtggatcacgaggtcgggagatcaagaccatcctggctaacacagtgaaaccccgtccctactaaaaatacaaaacattagccaggcgtggtagtgagcacctgtagtcccagctacttaggaggctgaggcaggagaatcatttgaacccgggagggggaggttgcagtgagcagaaatcgcaccattgcactccatcctgggcgacagagcgagactccatctcaaaaaaaaaaaaaagaaaagaaaagaaatgatctatcaagccatgaaaagacatggaggaaacttaaatgcatgttagtaggtgaaagagccaatctgtatgagtccagttctaaacactctggaaaaagcaaatacacagagacagtaaagcatcagtggttgccaggagttggagaggagagggatgaatgagtggagcacagaaaatcagggcagtggaactatcctgtatgacatggaatggtgggtgcatgtccttactcatctgtctaaaccaagaatgtacaaatcaagggcgaaccctcgtgtaaacgtggattttgggtgatggtgcgtcagccagctttcatcagttgtaacaaatgtaccaccctgcacaggatgctgacagttgggaaggctgtgtgggtgtgaggacagggatgtataggaactcagtacctgctgctcatcaattttgctgtgaacctacaactgtttgaaaaaattaagtctatttaaaaacaacaaaacatggccaggcacgatggcttgcacctgtaattccagtacttcgggaggctgaggtgggtgggtcacttgagccaccctgggcaacatggcaaaatcccacctctacaaaaaataaaaattaaaaaaaagttagctgggcatggtggcacactcttgtagtcccagctacttgggaggctgacgtgggaggatcccttcagccctgggaggtcgaggctgcagtgagctgtgactgtaccactgcactccagcctggatgacagagtgagaccctgcctaaaaaaaaaaaaaaaaaggctgggtgcggtggctcatgcctgtaattccagcgctttgggaggccgagatgggcggatcacgaggtcaggagatcgagaccatcctggctaacacggtgaaaccccgtctctactaaaagtacaaaaaaaaaaattagccgggcatggtggcggacacctgtagtcacagctactcgggaggctgaggcaggagaatggcgtgaacccgggaggcggagcttgcagtgagccaagatcacaccactgcactctcagcctgggagacagcaacactccgtctcaaaaaaaaaagaataaaacccatggctgggatggaccctgaacctgcagctgcagctgttcctgggtaggtctgtgggcgacgtggctttgcttctccatgttcccaagagacaagcatcacccatccatgagaaacaagcacatcctcagggcgcccttacgtgatctctggccaatgaaccaagacaaagtgagcagacaccaggtctgggatggcaggtcccacccccaccagtgcccagtgtgccctgtttggaggtgaccacagggtgtgtgcccagaggctgggcgtgactctcagcggagaccagaggggaaccacaccagcttggaggactcagttcccatcccagccagctgggatgagccacaggacacaagggctggcagacctattgtgttttgtccacccttcacagcagagaaaggggacagtgcccagaatgtcctctgaggagcctcctcccactcttggtccttgtaaaatggtgctgactcccttgctcccttcttcctggggtgggcggcaaaccccattcccctcagccttagcaagtgatttagaaacaggcagctcgcccaagccaggcatgagagtgatcccgggacacagggagaacaagccccgctttgccctctgggggtctccattcagcagaagaggcaaatgacagacacacagccgcctcctcccccaccatggtgctctgcagcctcaggagcctcaggtgcaccaagggccaccccatccagggggccatgcttccttgagtggtatcgttcctgagcgagtaccatctccaccttccagaggggctgtgacaagatcaacaagaatgagggcataggagcctcgaaccaaacatgccctcttccctgcagaggctgactgcgcccagctgctatcaccaagcccctgctcctccggccccgtggggacagggtaagaggggtgtcacatggaacagctctccaaacagtccctctcaagctgctgtctcctgtgcatctagtgagaacccaaccaacaaagggaaggtgggaattgctattcccattaggcagatgagaaaactgaggccccgaaaggctggcctgttccaggttacaggcgctgagcggctgctctgggaacacacttggtgtctgctgagggcccgagcccggccatcatatgactcacccttcgccagcaaagcccgggtgtgggtgaacttttcctggcagcctgggactccaaggtgctggcagccagcccagggaaggctcccgcgtgcctgcggcagacgccttgctttacctgcacgtccccacccctaggagcctggacagagcccagaccctccgccacctcctgagaaggtatcaggggcatcagtctggacttgggggggaatccacacaggccttccccaaatgctccaccgtggcccatggaaaaggctggaaaacgtgcaggagcaggagcctccgcatggagcataattcacattccttccccgagtttcataacagaggcctgctggtttccttaaatggggaatttgcgagccagtcggtgaccagagactggttggcgtggacgtgctcttgcagagtctcaaacgctaccacaagcccagccaaattccacggaggaaaatcgacttccgaagaaaagagctgcagcatggccttcgtgcagagccagctgcggttgtggttgtgtgttattttagggaagggccattttgcattttaaagagggggttgggtttcaccctggctttaatttgagacccgggggccactgcagccccttgtcaggctggtacaggccggggactcctcccatgctaagccagtgtctttctggccccagatcctcaggggccagagggtcatccccagagcccgctctgccacccacatgggtaccctgggcctgggagggatgtgccttccctcaaccctgcctggatgtccgcacggggccacctgcattgctgaaactgcaacgaagtcgagtctcaggaggggcccccctggctgcagggctcttgatccttttggccacgtgcacactgaggtggacgctcggacccagagacccccttcatgatgatggccggggcaggaaccccctcctctgaggaaggaccctggtgggggacagcactgcaggagggcacaggagatgacgggggctctagcagggccgggaggaaggccaagatgctcctcgcaaccgtgtgcctgtggccaggacagaggacaaacccaccctccactgtccccactctcaggacagcagtcctgccccaggactcagcgcccacacttatgcctgaggaccactattcaagtcagtatttggcgagcaggggttgctgccgcgggcgctgtgacaggctggaatcctctccctctccctctccctctccggagacatggagcctacagggacagagtcagcacctcagggtaggaccatggctggcgtcatcagcatcactggatctgatgagtgggagccggcatctcactgttttcactctctcattcaaatgactggagcaaagggaaggtgtggggagaggcccaggaatcaacactaaggtcaactttgcccccaggggcaggggtgggagtgaacagccacaggtgtgatcctggggagggcttctgggagagaattcagaggcaagcatgtagaggaaccatttcaaatagttaagaaaagccagagccaaacagggacagttggctcgcagagatgatgcaggcaaagccagctcagatctgagcatgggaaagactactcccaaccaagggcccagcatctcccaaccaagcaccaagtacctcccaaccaaatgccaagcacctcccaatcaaatacctcccaaccaagcacctagcacctctcaactggacaccaactactcccaaccaggcaccaagtacctcccaaccaagtgccaagcacctcccaaccaagtaccaattacctcccaaccaagcgcctagcacctcccaactgagcatcatgcacctcccaacagagcatctagcacctcccaactgatcacctcccaacctagcaccgagcacctcccaaccaagtgcagagcacctcccaaccaagtgccaagcacctcccaatcaaatacctcccaaccaagcacctagcacctctcaactggacaccaacaactcccaaccaagcgccaagcacctcctaacaaagtaccaatcaccttccaaccgagcacctagcacctcccaactgagcatcatgcacctcccaacaaatcacctagcacctcccgactgatcacctcccaacctagcactgagcacttcccaaccaacatagcaaaagccataaagaagtaaaaagacaaaaccacgtaggcatggagactggacttctggtggcgaggaaagggcatttttattataacgacagctaacatttgttgaactcacaaactgttcttggtgttttcctcatgacatgcagcatggtcacgcctctgtacagacaaggatactgaggcacagagtggcaccgtgccaaccttgtctcatctttttatcgaacctacatgcagagtgccagcaaatccagctgtcttttctcttcagaacagatcccaaatctcgccactccttacccccacaagtgaggtgtccccgctgctgctttctgtcgccaggatcccggtaataaccgtggagagggctcctgcccccacgccacccaccccacagctcactctcgctccagccaccaggggatgccttccagcacgagtcagagctggcacctcctctgctcgagacctcatgtgtcctctcctcacaccttgggccctgtttccctacattctgctacagcccctcaaacaggccccgccccaaaccagcccagggcctttgcactggctgatccctctgcctggaccgcgctgcccccagacagccacacggttctcagcctcatctgcttccagtctcgactcaaaagtcaccaagaggccttcccagcacctgagctccgacggaagcccctcgccacagcacccaagcactgctttatccccctacgcacacgtccctttcaaatactattcatttaccatctcctcccactcactgaaagggccagagactgggctatacccgctgcgtggggagcaggaccaggcgcaagggctcacaaatgcagtggatgcctggttgggaggtgagggagctgcagcgacccacgctgggagggaacgcaatgacaggaggagcgcaggtcctggcgacacgatggccatggcagccgctggtgagcaaccgcaggccggccctgggagagggcttctagcaagctgctatcttcagcctctccgactactgcagatgccccctcctagccagagacactgctacaccagccgacccttccaaaaagaaggtcagtaaccccgcgactcctggagccacagtgcagggggagagggctgagagggcaacagttcaccaagcggaacagaggctgccccggaggtcagctggctccccggcagctgcaggggtggctagcccactcggagggcagcgagggcatacgaggggctccagggatgagtggttgcccagcacagcacccctgggaggccgggggcacttctcaggtagtgggggcacgaggctgctctggcctgacctcagggactcaaaatactttggcgataaattccaccgtgtcccacccctgctggtaccccatacttacacacagactggttcagatgcagacactctcgcgcacatactcgctcacacgggcacatacacgtgcacacacagtcacatgcgcacactcatacacacacaaatatccactcacacgcatgcatgcacacacacggacacacacaggctcacacgtatgcacgcatatgcgtgcacacgcacacacacacacacacgctcacatcctcccactcccacactcagttgctcagacacacacacgcctggctctcacacaaacctgttgggctctgaaaggctccagcccttcccatgctcgtcagaagccagtcaatggcttcctaagtcaccacacagatcaaagaggtgaacttggccacatggcactctgcttcctgagctcccaaacaccagccttggtgaggacagaccctcaccccacaccctcattcccactaccctgggcaggcccagaggaggggcatctgcaggatctggcaaccagcccctcccgcccggctcctgcagccggcaccatgggagtcagggggaggtcactgcaaagggcaacagcaagttggtggccccaggactagagcccaggggtcttcagtcctactccagagcttggacactgtcccacagggcatggccaagggaagggcttccagagccctgacttcagggaggagggcaggcgggctcctgtggcaggcctggatgcatggccgcccactcctgggactttctaacctagaatatctaggtcaggctgggtgcagtggctcacgcctgcaatcccaacactttgggaggccgaggagggtggatcacttgaggttaggagtttgagaccagcctggccaacatggcgaaaccctgtgtctactaaaaatacaaaacctagccaggtgtggtagtgcacgcctgtaatcacagctactcaggaggctgaggcaggagaatcacttgaactcgggaggtggaggttgcagtgagctgagatcgtgccattgcgcaaagaagatctaggccggcccctcaaccggtgaggtccaggctgggagtgctgagagactgtggtgacactgaatgaactaacaggcaaagggcttccaactgagcctgggggtggtgggaaatggctcttgtgttctagtcaagacctctgccaaccagttctgacactgacccagcacagaacctgacaggtcagcaagggccagggcttagcacagcccaggtaagggtgtgtgtacggcccccagagtcactcccaggctgcaagaaaagggacaaaggagggacaaggggtggccaagcaaactgttccctctgctcgggagtctggggtgacctggcctagctggccagtggagctgggccacctccccttaaactctccaccccggacttcgactccaaagctttcctgccacccacgctctccccacctgggatcacggccaggccctgagccttcaagggcccaggtgaactcagccagactaggagctgaggaggacacagggcagcttccagaacggacccgagaaccactcccagcaggttctgcttccagacaaggagctgcactttttcagccaatgcaattagaaagccaggagaaggtgcaaattccacctgcctgagcgtccgcacttcccaggccgcccaccatacacacagcaaagatgtgtttaaccattcaaacccatggccaaccacatcggttgcctcagacatgcaagttttaaaaaggaacataactatgggccaggcacggtggttcacgtctgtaatcccagcactttgggaggccgaggtgggtggatcacctgaggtcaggagttcgagaccagcctagacaccatggtgaaaccccatctgtaccaaaactacaaaaattagctgggcgtggtggtgggcgcctgtaatcccagctacttgggaagctgaggcaggagaatcacttgaacccgggaggcgaaggttgcagtgagccgagattgtgccactgcactccagcctgggcaacaagggagactccatctcaattaaaaaaaaaaaaaaaaaaaaggaacataactatggagtctcaaggggaagtaattccttcaacaataacaaatcttgaaagctgagctcttttttttttttgagacaggatctcctcactttgtcgcccaggctggagtgcagtggtgggatcacagctcactgcagcctcgatctcccaggctcaaatgatcctcctacctcagcctcccaagaagctgggattacaggtgcataccatcacacccgattcatttttgtatactttgaagagatggggtctcaccatgttgcccagtgtggtcttgaattcctggactcaggtgatctgcccgccttggcctcccagagtgctgggattacaggcctgagccaacacccccacgggttcattttcagagtcgcaccgagtgctggggttacaggcctgagccaacccccccacgggttcattttaagagtgacaccgagtgctggggttacaggcctgaaccaacccccccacgagttcattttcagagtcgcaccgagtgctggggttacaggcctgagccaacccccccacgggttcattttaagagtgacaccgagtgctggggttacaggcctgagccaacacccccacgggttcattttcagagtcacaccgagtgctggggttacaggcctgagccaacccccccacgggttcattttcagagtcacaccctttttctgaaaaacaacttgggctcatgcaaattcgagagagagatggtgacactccccgccccctggacccaggtggagtcgcagcagggtttacccgtgagcggggtccaaggcgatggccctcggctggtcaaggtcctgccagaagagcaccttccgggatgtgccattgaggttggccacctcgatgcggttggtctctgagtccgtccagtacagcttcttgcccacccagtcgcaggcgaggccgtcgggagagaccaggccggagatgaccacgttctgcacggcggcccccgtctggttcaggtaggtctgcttgatggcctcctcgctcacgtctgtccagtacacggctcccttggaaaactggaagtccactgcggccgcatcctccaggccgctgaccacgatggtggactccagcttgactccgccggcgtccaccagccgtacgtcccggcggttggcaaatagcaggagcggcgaggctgtggggcagaagcaaaccgtgagggccactggctaagccagcaagatacacagccctgggatggagcactatgcccagagcactcctggtactgccctgcccatgcccaagacctccagttccttcctcccacccctaaggcgttgtcaggaagttgcctgggcagccccggcccgcatcattcagaggctcctgcagcgcagcaaacagccttcttcccacattcggtgacagcacctgtttgtttaccaactgttacgtctgttcccccagatatgggtgacccttcctgccatgcccaaaacctcccacatcgtcctccagaggctacaggggccctgtcctgttctgcagagaagccacatcccctttgttggcctgacacaggggatggggacatgcaggcacagcactggccatgctgctcgctacagacccagccacagggccacattttttgaggggttcagagcccaggccagacagagcctcaagattcccttacaagtctttgaccactgtccaagctcaggcccgtttccttggccgtggcatcagcttcccatccacccctgtattccatgtttctcccaccctgcttctggacattcctacatttaaagggtcactctggaatgccaccccttggctcagacaccttccacagctccctgtgccagtgccatgcagaacaaggtcagaccccctagcctggcctccaaggccttggcctctggcctcacctacacttctctccaccaccccaccccaagcattcctgatctgcctgcggccaggctggctccctcacctccctgtgcaccgcagccctcagccccttctgcctgtgcaagaagcctcatctcacagacaacggtctcattcccacaacgggctcaatgagaaatcaggagaggccttcagaccatcaccccaccagacacctcagacgtcggaccaggagggtccagcaacccccaacacagactcagagggactaagaagccacatgaggagtgaacacaagatgtggacaggaggaggttaagggcctccagggagctccatcagtccgtgttctgctgtcagcagggttaggctgggctggccacaaacacccccaaaaaacatctgaagccttggcttgaaacagctgacattcctcatgaaaactgcagacccctgggtcctcctgcgcagatgggggagcccagccaaccccacactcccaccttcaccaagaaagagaaagccaaaacaaactcaactcagccaatgacaatcacagaactgaatcctgtagttagttcagttggtttcatttcagcaggggaaagatttgcagcctctatgagggtagctgggaacacaaagggccagagcatggcccaggagaccccagcgcagtggggtagatggttccgagcacaggcctccctgccaagacaagcactggctcaaatcctggcccctcccattcccaggagacatgctccacaggatgggaggacacacagaggacctgaggccaggaaaatgacagcggcgcctccgccgccccacccgtgctgtcatcatcttaggtctacagttctttgtggcaacgagggacactgtgaaagtcaaacaacaggaaggcataggccacaaataaagacaaacgggacttcatgggaagctaaagattttgtgcatcaaaagacactatcgagagagtaaaaaggcaacccacagaatgagagaaaatatttccaaatcatagatctactaagagattaatatccatgaaatacagagaactcctaaaactcaacaatgagaaaacaactaagccaactcaaaaatgggcaaacaacttgaacagacatttctccaaagatgacatataaatggccaataaacacatcaaaacaggcttaatatatccctaatcatcagggaaatgcaaatcaaaactacaataagataccatcttgcaccaattaggacggctactatcaaaaaaacaaaatagcaagtgttggtgaggatctggagcaactggaacccttgtgcaccactggcaaaaatgtgaaatggtgcagctactatggaaaacagcatggcagttccccaaaaacttaaacacagaattaccatatgacccagcaatttcgctttgggttatatacccaaaagaactgaaaacagggacacaatcagatatgcatacaccttggatcacagcagcatccttcccaacagctaaaacatggaggcagccaggcatggtggctcacgcctgtaatcccagcactttgggaggctgaggcgggtggatcacctgaggtcaggagttcgagaccagcctggccaacatggtgaaaccccgtctctactaaaatacaaaaattagctgggcgtagtgacgggcacctgtaatcccagctactcacaagtctgaggcaggagaatcacttgaaccctggaagtggacgttgcagtgagccaagattgcgccactgcattccagcctgggtgacacagcgagactctgtctcaaaaaacagcaaaacaaaaacaaaaaaacaaacaaacatggaagcaacccaagcgtccctctactgagggatgaatagcggggcaaaatctgctccatccacacaatggagtactattcagtctcaaaaaggaaaaagattctggtcaggcacggtggctcatgcctgtaatcccagcacttggggaggctgaggcgggtggatcacctgaagtcaggaattcaaggcccgcctggccaagactggcaccnagctacacanaaagtatanggccccggaaa

SEQ ID NO: 9 - DNA, 72049 bp, Homo sapiens
  unsure (8356),(8385),(38585): Identity of nucleotide sequences at the above locations are unknown.
tataccttgcgcggaccttcggctcctgtggtgaagacaatatgaagaaaatagaaattacccataattttgccacacagacttagttgtgtccatgtatcttgtgcaccttttttctgtttacggatcaaaatcgacttttagggtcaggcgcggtggctcacacctgtaatcccaacactttgggaggctggagttggggttggggggtggatcactgaagatcaggagtttgagaccagcctggccaacatggcgaaactccatctctactaaaaataaaagattagccaggcgtggtggtgggtgcctctaatcccagctactccggaggctgaggcaggagaatcgcttgaacccaggagacagaggttgcagtgagccaggatcacgccactgcactccagcctggcaacagagcgagactctgtctcaaaaaaaaaaataaaaataaaataaataaatacataaattgacttttaggagattggttcaaacaatgtgtgtaatgttgtgtctgagtgtttttcatttatcgttcatgcaaattccgacatcattcactcttctccagagtgtgctgttttcctgcctgtgtcatcacccgtcaccttgaatgccctcgtttaggtaaaataagtacattttattcaaaaatatttgaggacatttgggttgtctccaggttcttggtcttgagttttgctgttcttgtggagccatggtggtgtctggttgcaggaacctccatgcgttccagctgctgcttctgcctgtgttcttagagaggaaatgctggggtccgcggttcccgggctgctgaccaggaagcctgcggtgctttacggcccttccagaagcgggagatgcccccacttaagtgtcagacaggcctttccacctcactggcagctctgagcggctcccttctatttgcagatgactgagaagttaccaatttccacgtttactgactgctgtttctcctgttaatttgtatttatagtcttcgctaatttattgctagggttttggtgttgtccctattgacttgtatgccttttaattttttaaacaacattaatatacttcatttttttagagcagttttaagtttacaggaaaattaagggacaagtacagagagttccttccacctgctgtcctcctctcctcctccccaccttccctccttcccctattgtaactttctttctgatattataaaagtcactcatggctgggcgtggtggctcacgcctgtaatcccagcacgttgggaggcagaggcaggcagatcacctgaggtcaggagttccagaccagcctggccaacatggtgaaaccccgtctctactaaaaacacaaaaagttagccaggcgtggtggcgggcacctgtaatcccagctactcaggaggctgaggcaggagaatggcgtgaacctgggaggcagaggttacagtgagtcgagatcgcgccactgcactccagcctgggcaataagagtgaagcttcgtctcaaaaacaaagtcacacacgcttcttgtacgagggtcatttggccgaggggccagatggctcaccatctagttgggacaggccatgagctcggaatgctttttacatatttacatggttgagaagaaaatcaggagaataatgttttgggacatgggaaaatgacatggaatttgcattttagtgtccataaatgaagttttgtttgctcccagctgtgttgactgaggcaggctggcttcctacagctgcggcagagctgaggaggcgggaaggagaccgtgcaggccgcagcaccgaaaatatttgctctctggcccttcccagagtgcttgccgacctctgtccgacagctagaaggaaggataggacccgtccgacgataaccactgttgacatttgagcgcgtttccttcccggcttttgtgtgagagtggcagtctgtttgcttttgtggtcgggatctgctgcacgcacggcgggctgtttgcatgaggcttcctggaggatagggctgggctcggagctgcacgcagtggggcgtgtcctgcatgcagtggggcctcagaagagagctgtggtgggcggggcagtgccaacgctggtgggtgccaggcctccacgctcagatcagccccggcgacaggtttgggccaccctctctctggcctctgtgcagtggcccaggccgtctgctctgcctggcacacttgcctctgtccttccactgaagcgctcctcttaccctctgctcccggctgggtacgttgaattgtgtccctcaaggagatatgctaaaggtctaaccccaggaacctgtgtatgtgatctaatttggaaacagggtcttggctgatgtaatcaagcgaggatgaggtcaccctagagtagggggcctatatccacggtgctggtgtcctcatgagagcaggtgagcagacactgacactcaggggtgaaggctgcatggagtcagaacagggcttagtgcgatggcggccacaagccaaggaactccaagtatttcctgcaacaccagaagctggaagatgccaggaaggatcctgccctggagccttcggagggagtctgtccctgcagacgtcttgacttttgattgcagggatgcatgtcttagggtgtgtgggggggtgcatttctgatgttagaagccacctggttggtggcgatgtgtcacgggagccctctgcaggttctgcgtgtccatgtggtcggggacagaggtgggcagggacggacggtgtcgagctggacatgtccatgacgtcggccatcccttgggatggcttttttgttttgaggataaggctgcctgccaggaagctgtgccctgcctggcccttgccccaagcccctggcctgtgcttggcctcgcggaagggatgtcgcccttctctcctgcatgcgtgcagggaggaaggggagaggtcagcagcccgcctggaggaggctcgggcgaggggaaggtttcactttcaggcaatgttgtggggctgtttaaacaaccccaaagaaaaccatttggccaaactgttagtttccaaacattttacttccttggtgtttaaataaattcctaccaagactctgtagctggtcccagggaaggagttggcctctcttctttatagcccggcacagtcagtcccctgcacctgcccctcccaaccccaggcctgcttccccgtggccatggctgctgcccggacctctctacacacagaacctcctggaggccagctgtgggcaccagccttggcagggctgtggcggagcccaggctgctggtactctctctgcagctgctccctgctggcctggctggacagcgtccccaccaccactggggtcacctctgtgctggtcacagctcactcagaccttcaggcaaatgggttggatcctgcctctctcccaggtgtctcagtctctgcaaaactcaaaaacctcagaggccttgcagcctgaggggtgtcagagacacctccttcgaatcagtaaacacctacagattcaccccagcagtgaaaggactgcttcgccacagaggtttgatttactcctaagtaattggaagggatgccgagaataggttcctcatggtgggactagaggccctctgctgacctagttaacagagggctagggctgggtgtgctcagcccctgaaggttctaggcccatttgggacaccccgccagaacctgccacaacctgccatgtggtgacagctacctaaatcccagaggctcttgagctggagagcagacctctcaatctcagcaggccccccacacagaccccataaccctagtctgccttcacagtacagttcgtggctatgtgttcacggatggtgttgttcacctaaggtctctgccctgtgaccccaagggcgtcctgagggcagattccaagtctgtttcgtccacccctccttccctagcagcgggtccagggcctggcctgaactagcttcccacagagatactggtgggatgatgaaggcagccaggcggcaagtgaaaaacgcacttcctgcatgtgctggctcctgggattgaagtgtttgaggaagcaaagtgaagtgagctttcctcttgcggctgtgtgtccttgggccgggagcctaccctctctgagcgttggggtccttgtcagtagaatggggcatcctcatagctcaaggggtggtgtgtgaaaattgtgctattgtgttactttaatgattttttttttttcgagacaaagtctcaccccaacgcgcaggctggagtgcagtggcgcgatctcagctcattgcaacctctgcctcctgggttcaagtgattctcctgcctcagcctcccaagtagctggaattacaggagtgcgccaccaggcccggcatatttttctatttttagtagagagggggttttaccatgttggctaggctggtcttgaactcctgacctcaggtgatccacctgcctcggcctcccaaagtgctgggattacaagcatgagccaccgcgcccggcctactttagtgatttcttaggaggacagagggaacgggctggcaagacaggcttggaatgtgttttgggatcaagtgccggtttctgtctggcactggcgttctctgtggggccatgatggacacactgctgaggtcaagcgtgattcgtcttgcgctgtgcctggcagtctcattggaaagttctgtagacatcgtgtggatggggctcttcccggccaagcccttggggaccttccaggactgtgatctccccacagtggctgttaagcagggacctttcgtgaagtggagtctctggtcccctccaagtcatagctagacagggactcgggcatcgccaagcctggctgattattcactggatgaggagacaggcccagagaggggcaggaacctgcccgaggtcacccagcaggccccagaggtttcggtctcggattctccctgctcatccctggatgtagtgctgctgtggatgtggttctgtgctgggggctgtggagagcagggggcttgtgccaggaccccagtgagggtggcgccctcgccatgaggccgactgttggtatggggcggccatccactggggtgtggggaggaacagctttcctgaggaggaggtggcgggaggaacagcttccctgaggaggaggtggcggtgctgtgtgacctgggccttgaaggacaggtccattgtcaacagaacattttgggagtggagcctagagggagaaaatttgttgaaattcagattcccctccccctaccaatacacaccaaatcagatgcccctgaccagatctaaatttggctctcagagatttccattgtagctgggcacttggggaaccttctaagtgctgcctctgcctctccccagcctgcctgcctcagtttccccagccctgggcccgtgtcgctgttgccatcacgtgggcgccctctagtggaggaatcagattatgcactccggggcttggagcaggagtcaggaggggctcctgtctttccttgaaacgttggatgccgggatcctggaacagtctctgcattcctcctggcgagaaccagagcctgggcacaggggaccatctgttgtttgaaggctgcagcctggcagggcactcaggagatctggcagttggctgcagggccaggtctaggggccagggcatcagggaggctctgggctggttcagccccgggcccctttgcagattgtgacctgggcccctgtgcaggggcatggccacaggatgctgggaggggtctctgaccctgaccttcttggctctgtgcatccttgagaccagaaaggtctggaacaaatgagtagacgatgccctaacctggggagggagccacatcctgatcccagcaacctcgggaaggatctgtcaggattatggggcaccctgggggccccaagtctgcatgggtctccacttgcaatttctgtaggaagctctgataaatccaaactgggggtcctaggacacagtcagaaatgctgataccgttgtgtgtggagcctcgggccctgggggtcaggagcatgtggagggtgggccacgggggttcagaagagaatcctgtaaccccccaccccccaaactgaagcccacttgagggccatggctgaaaggttggggggtctccgtgcgtcctgtggagtgggtggtgaggagtccttgggtttgcacgcctctgggcctgagcggcgggaccccgtccacagcggatccctgggccctgttgctcagatgctctcagagtgttgctgtggccacggagggagcctgagttaagcttctcttgtgccggttgtacgctgtcaggtcacactggtgagttaggcagggcacagatgcccagagcagagggaactttccttggggattcaacacgtgcaagtcttaggggctggcaaatcctgccctcagctagagagggggcttttatttgagaccagaatcacctgagcatcctcctgtccccagctgtgtccagcctgtctgcagggacatcctgagaggaccaggctctcccctcatccacctgcctaagtgccactctgaaccctgtccacctgtgccgtggaggggcgtgacctcaagctgctcagccagcagcaggcttggccctggggggcagcagagacccaggtggctgtggggtgggtgcttcgtggcgtggttctgaaacttcgttggaagtgtgtggacagtgccttgcctgttctctgtgggaccctatttagaaacgaggtctgagttactgggggtcatcactgtgttctgatggcccagctgtgtggaggccgcggtgcagccccatccaaggagccagggccctgggtctagccgtgaccagaatgcatgccccggaggtgtttctcatctcgcacctgtgttgcctggtgtgtcaagtggtcgtgaaactctgtgttagctcttggtgttcctgaaagtgcccccgggtctcaggcctcagaaccagggtttcccttcatctcggtggcctgggagcatctgggcagttgagcaaagagggcgattcacttgaaggatgtgtctggccctgcctaggagccccccggcacggtgctggggcctgaagctgccctcgggtggtggagaggagggagcgatgaagtggcgtcgagctgggcaggaagggtgagcccctgcaaggtgggcatgctggggacgctgagcagcatggccagcagctgggtctgcagcctggtacccggcgggacttgtggttggggctggtttgtggccaggagaggggctggcaggagacaagggggactgtgaggcagctcccacccagcagctgaagcccaatggcctggctgtgtggctctcagctgcgtgcataacctctcagtgcttcagttctctcatttgtaaaatgaggaaacaaacagtgccagcctcccagaggtgtcatgaggatgaacgagtgaccatgtagcatgggctgggtgcgtgtcacctaacatcaccagcctttgcaaggagagccctgggggcctggctgagtatttcccttgcccggcccaccccaggcctagacttgtgcctgctgcaggcccttgacccctgaccccattgcacctgtctccacaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatggggtaagacgggcgggggctggggcctggagccagggccaggccaagcacaggcgagagggagattgacctggacctgtcattctgggacactgtcttgcatcagaacccggaggagggcttgttaaaacaccggcagctgggccccacccccagagcggtgattcaggagctccagggcggggctgaagacttgggtttctaacaagcaccccagtggtccggtgctgctgctgggtccatgcgtagaaagccctgnaaactggagggagccctttgtccccctgncttcagtttcctcatctgtagaatggaacggtccatctgggtgatttccaggatgacagtagtgacagtaagggcagcctctgtgacactgaccacagtacaggccaggcctctttttttctttttttttttgagatggagtctcactctgtcgcccaggctggagtgcagtggtgtgatctcagctcactacaacctctgcctcctgggctcaagtgattctcctgcctcagcctcctgagtagctgggattacaggtgcctgccactgtgcttggctaatgtttgtatttttggtagagatggggtttcaccgtcttggccaggctggtcgcaaactcctgacctcaggtgatccacctgcctcagcctcccaaagtgctgggattacaggcatgagccaccacgcccggtcaggccaggcctcttttgaacactttgcacaccatgggtcttttcatccaggggggtaggtacagttgtacagttgaggacactgaagcccagagaggctcagggacttgcccagggtcacacagcaggatgtggcaggtgtggggctgggcctggcagcgtggctccagctttccagcatagaaatctgtgaaagcagatagtttgtcggtcggtaggggagactttctgagacccgccccagcggctcagagggtagtagccaggggccttcctgggggctcataacccagaacactgaatgggaaaaccctgatggaggaggcgcagtggagctgtgggtgccgatgggaagtcccagaggagctgggaggtcagtagcggtgctgccctctgtggagcacttagtgggcaccaggtgtgtttccaggttcatggccctgggacctgaagctcagaaggtgaagtaacttgcccagggcacccgtcgggcagcggcgggcagaggatttgtgggctgtggagcctgtgctcgtggcccagccctgggggttgtgagtgtgctggccggggagcttttcctgcaagtggactggtgtctaggagccagcatgtcaggcagcaggcagcgggagtgcagcaggcagcgggagcacagcaggcagagggcggggctcgagcagccatccgtggaccctggggcacggaggcatgtgggagagggctgctccatggcagtggctgaagggctgggttgtgccccgaggagggtggatgagggtaagaagtggggtccccaggggctttagcaagaggaggcccaggaactggttgccagctacagtgaagggaacacggccctgaggtcaggagcttggtcaagtcactgtctacatgggcctcggtgtcctcatctgtgaaaaaggaagggatggggaagctgactccaaggcccctcctagccctggtttcatgagtctgaggatcccagggacatgggcttggcagtctgacctgtgaggtcgtggggtccagggaggggcaccgagctggaagcgggaggcagaggggctggccggctgggtcagacacagctgaagcagaggctgtgacttggggcctcagaaccttcacccctgagctgccaccccaggatctgggttccctccttggggggccccagggaacaagtcacctgtcctttgcataggggagcccttcagctatgtgcagaaggttctgctctgccccttcctccctctaggtgctcagctcctccagcccactagtcagatgtgaggctgccccagaccctgggcagggtcatttctgtccactgacctttgggatgggagatgagctcttggcccctgagagtccaagggctggtgtggtgaaacccgcacagggtggaagtgggcatccctgtcccaggggagcccccagggactctggtcactgggcttgccgctggcatgctcagtcctccagcacttactgacaccagcatctactgacaccaacatttacaaacaccgacattgaccgacaccgacatttaccgacactgacatttaccaacactgtttaccaacactgacatctactgacactggcatctaccaacactgacatttaccgacactgacatttaccaacactatttaccaacactgacatctactgacattggcatctaccaacaccaacatttaccgacaccaacatttaccaacactgaaatttaccgacaccgacatttaccgacaccgtttaccaacaccgacgtttaccgacaccgacatttaccgacactgatatttaccaacactgacatctactgacgctggcatctactgacaccgatgccagcatctaccaacaccgacatttaccaacactgacatttaccaacactgacatttaccgacattgacatttactgacactgacatctactgacactggcatctactgacactgacgtttaccgacactagcatctactgacactgacatttaccaacaccagcatctaccaacaccgacatttaccaacactgacatttactgacactgatatctactgacactggcatctactgacaccaacatttaccaacaccagcatctaccaacaccgacatttaccaacaccagcatttaccaacaccgatgtttaccaacgccgacgtttaccgacgccagcatctaccaacactgacatttaccgacaccgacatttaccgacactgacatttactgacactgacatctactgatactggcatctaccgacactgatatttaccaacgccagcatctactgacactgatgtttaccaacaccgacatttacgagcaccgacatttactgacaccaatatttactgacatcaacatttagccatgtgatgggggccggcttgggggcaggccttgctcttggcactggggatgctgcagagaccagacagactcatggggtcatggacttctgcttcttctccagcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgaggctcctgtggacatgtttgatccaggaggccaggcccagccaccccctgcagccagatgtacgtattggcgaggcaccgatgggtgcctgtgctctgctatttggccacatggaatgcttgagaaaatagttacaatactttctgacaaaaacgccttgagagggtagcgctatacaacgtcctgtggttacgtaagatgttatcattcggccaggtgcctgtagacacagctacttggagactgaggtgggaggatcgctggagtccaagagtttgaggccagcccgggcaaaggggacacaggaatcctctgcactgcttttgccacttactgtgagatttaaattatttcacaatacaaaattaagacaaaaagttaatcacatatccactgccctgcttaagacagaaaacatgggtgttgttgaagccagaggcagctgctggcctgagtttggtgattggttcctaagcagttgaaggcagttttgtttttccatagatgtctgttctccctttgctgggtgcagcctcgccctgctgctgtggtcgggtttcagtggcctcgtcccgtggacgcagcctcgccctgccgctgtggtcgggtttcagtggcctcgtcccgtggacgcagcctcgccctgccgctgtggtcgggtttcagtggcctcgtcccgtggacgcagcctcgccctgccgctgtggtcgggtttcagtggcctcgtcccgtggacgcagcctcgccctgccgctgtggtcgggtttcagtggcctcgtcctgtggacgcagcctcgccctgccgctgtggtcgggtttcagtggcctcgtcccatgggcgtgctttggcagctttttgctcacctgtggagcctctcttgagcttttttgtttgttgtttgtttttgtttgattttgtttgattgtttgtttttgttgtcgttgttgttgcccaggctggagtgcagtggcgcgatctcagctcactgaaacctctgcctccttgggttcatgccattctcctgcctcagcctcccacatagctgggattacaagtgcccgccaccacgcctggctaaattttgtatttttagtagacagggggtttcaccatgttggtcaggctggtctggaactcctggtctcacatgatccacctgcctcggcctcccaaagtgttgggattacaggcgtgagccaccgcgcccagccctctgttgagcatattttgaggttctcttggtgccagtgatatgtacatgtgtccccatcgcaccatcgtcacccattgaggtgacattggtgcctctcctcggggtggatgcctccctctgtttccagcaacttctgaaggattttcctgagctgcatcagtccttgttgacgtcaccatcggggtcacctttgctctcctcagggctcccaggggaggcccgaatcaggcagcttgcagggcagggcaggatggagaacacgagtgtgtgtctgtgttgcaggatttcagaccctgcttctgagcgggaggagtttcagcaccttcagggtggggaacccagggatgggggaggctgagtggacgcccttcccacgaaaaccctaggagctgcaggtgtggccatttcctgctggagctccttgtaaatgttttgtttttggcaaggcccatgtttgcgggccgctgaggatgatttgccttcacgcatccccgctacccgtgggagcaggtcagggactcgcgtgtctgtggcacaccaggcctgtgacaggcgttgttccatgtactgtctcagcagtggttttcttgagacagggtctcgctcgctcacccaggcgagagtgcagtggcgcaatcacggctcgctgtagcctcaatctccctgggctcaggtgatcctcctgcctcaccctctgagtagctgggactacagacacataccaccacacccagctagtttttgtgtattttttgtggggggagatggggtttcgctgtggtgcccaagctgatctcaaactcctgaggcacaagcgatccacctgcctcggcctcccaaagtgctgggatgacaggcatcagccgtcacacgcagctcaatgattttattgtggtaaaataaacatagcacaaaattgatgattttaaccattttaaagtgaacagttcaggctgggcgtggtggcttatgcttgtaatcccagtactttgagaggctgaggtgggcagatcacctgaggtcaggagtttgagaccagcctggccaacatgatgaaatccagtctctactaaaaatacaaaaattagccgggcatggtggcaggtgcctgtaatcccagctactcgggaggctgaggcaggagaatcgcttgagcccgggaggtggaggttgcagtgatctgagatcatgccactgcactccaatctgtgtgacagagcaagactctgtcttgaaaaataaataaataaaaaaaattttaaaaagtgaacaattcagggcatttagtatgaggacaatgtggtgcaggtatctctgctactatctacttctagaacactttcttctgccctgaaggaaaccccatgcccaccggcactcacgcccattctcccctctctcccagcctctgtcaaccactaatctactttctgtctctgggggttcacttcttctggacgttttgtgtgactggaatcctgcaatatgtggtccctgcgtgtggcttctttccatagcattgtgttttccagattcacccacacattgtcgcacgttatcagaatctcattcctgactgggtgcagtgggttaggcctgtaatcctaacattctgggaggccaaggcgggacgatcacttgaggcaggagtttgagaccagcctggccagcctagcaagaccccagctaccaaaaaattttaaaagttaactgaacgtggtggtggtgggcacttgtggttcccagctacctgggaggctgaggttggaggatcgcttaagcccaggaggtcaaggctgcagtgagctatgatcgcaccactgcactccagcctggacaacagagcaagaccctgtctgaaaaaaaaaacaaaaaaaaaagttcctttctttttgtggctggatgacatcccattgtatggccacagcacattttgtttgtctgtttatcgggtggtgggcagtggtttccaccttttgtctcctgtgaataatgctgctgtgaacatttgaattcaagtttttgtttgaacacctgttgtgaattatttggatatatgtgtaggggtaggattgctgagtcctatggtaatgttaggtttgacttactgaggaaccattaaactgttttcaacagtggctgcgccgttctgcatccccaccggcagtgtgtgagggttctgactttacctcctcacaaacgcttcttttccatttaaaaaaatattcagccaggtgctctggctcacgcctgtaatcccagcactttgggaggccgtggcgggcggatcacctgaggtcaggagttcgagacgagcctggccaacatggtgtaaccccatctctaccaaaaatataaaaattagccgggtgtggcagcgggcgcctgtaatcccagctacttgggaggctgaggcaggagaatcacttgaacccgggaggcagaggttgcagtgagccaagatcgcgccactacactccagcctgggtgacaagagtgaaactccatctaaaataaaacaaaaataaaaataaataaaaatttattaaaacattcatcacagccagcctagtgggtgtcccatgtggctttgcctcgcatttccctgataactaggatgctgagcgtcttgtcccaggcttgccacacctcagcactttgagatacgtcgcacagtccccatttgcgaacgagaaatgaggtttagggaacagcagctgtgtcatgtcacacagcgagcagggggtctctgagccgtctgaccccacagccgaccaagctccaatccttaccgcctcctagtgttgtggatgtagcccagggtgctcccacatttttcagatgagaacaccgaagctcaaaacaggagcgttttgtccacattggatacacgatgtctgtggtttggtcctgaagtcactttatatctcagtggtccagactggagtaggacagggggttctggggaatggggaaggtgtctcaggtgaaaggaaggaattccagattctccatactgtccttgggaagttagaagactcagagggtctggcaaagtcagacaaagcaagagaaatgcagtcaggaggaagcggagctgtccaggaacaggggggtcgcaggagctcacccccaggaactacacttgctggggccttcgtgtcacaatgacgtgagcactgcgtgttgattacccactttttttttttttttgaggtggagtctcgctctcttgcccagtctggagtgcagtggcacgatctcggctcactgcaagctctgcctcccgggttcatgccattctcctgcctcagcctcccgcgtagctgggactacaggcgcctgccaccgcgcccggctaatttttgtatttttagtagagatgggatttcactacattagccaggatggtctcgatctcctgacctcatgatccgcccgtctcggcctcccaaagtgctgggattacaggcgtgagccaccgcgcccggcccgatttcccactttaagaatctgtctgtacatcctcaaagccctatacacagtgctgggttgctatagggaatatgaggcttacaggccatggtgctggacacacagaagggacggaggtcaggaggtagaagggcggagagagggaacaggcggaggtcacatccttggctttcaaaatgggccagggagagacaccctctgagcatggtaggacaggaaagcaagattggaacacattgagagcaaccgaggtggctgggcgtggtggcttacgcctgtaatcccaacactttggaaagctgaggtgggtggattgcttgaggccaggagttcaagaccagcctggccaacatggtgagaccccgtctctactaaatatacaaaaattagccaggcgtgatggtgcatacctgtaatcccagctgcttgggaggctgaggcaggagaattgcttaaacctgggaggcggaggttgcagtgagccgagatcccgccactgcactccagcctgggccacagagtgagactccatctcaaaaaaaaaaaaaaaaaagataaaaagaccaaccgaggaattgaagtgggggggcgtcacagtagcagaagggggatcgtggagcaggccaccctgtggtcatgcactggaagctcattacctgacgatttggagctcatcactgggggcctaaggagaatagatactgaaggatgaggagtgatggcgcggggcacgggtgtctttggtggccagaacttggggactgctggggtgcctcactgcaggccttctcagcgccctttatatgcttacacaggctgtttctaagagggggatacattgcataagcgttttcagactacctcatcatgggtccctttctttaccctctgtggccctggtggcgcactctctgggaaggtgcaggtggatgcccagacccgccctgccatccacctgcacgtccagagctgacttagcctcgagattgctgctggcacctcctgccccgggacacctcggatgtgcccgtggagatgctggctctgtgttttctgctggagtttggtgcgtcttttcctcctgcaagtggccaccgctcttgggtatgtcctcaggcttctgcgagtcatggctgcttctcaggtccttgcccagcgccaggagcaaaccctcctggcactttgttcaggggtggatgcgccagtgttcctgctgtggaccgccatctcacatgagggtcttgggcctgcaggctcgttcaggaaacacccgctgagtatgcagtgtgtgccagctgtgtcccaggcaatggcggggacagtggctgctgctggggttgtggtggcttctggggactctggggacagctgaggtgcaaggagccacggctccttgaggatgcagttggactccaggtggaagggatggttgggggaggtataaatggggtcagggaggagacacatttggaacaatgggaacatttttaagatgctatgtcgggaggcaacaaggtggccaacccaggtgctgaggagcccacaccagccctggacgtgttttgccgctcacctttgctggggagtggtgggagagaggattccgttccacgtggtggtgtgcgcagctgggctgtgtggagctgggcgctaggaggaaggtgctttctgcggggctagccgggctctgcctttgaacacaatcaggctccaggttttcagcatccagtgcatgagaggacttcacgggcagctgtggctgatcccttgatgaattgggagaagaacaaaggtctatgaaatgaggtttcatgtagatggcattagagacgcccacaacagatttacagagtggagcggagacggcggatgggtctgggaggcccctcctgctggccttgactgtgacagctgtcctgggaatcagcttccaggccgccccagcagcctgactgacacacacaggggttttagccccatcctgcgaccagctgttgccatcatcagtgacagctgggagtggcggtggttccagccctgggcaccctccccacctgctggggcccacccagggcagtcctgacacctacaggttgcttggagccgcatccgagtcctgccccaccacgtgtgaagcccgagtggtcgtgggctgaggtcccctgattgcatccccacttcccttctgcttcacatagctgcctcttctcaccgtttttccagcctcctgggctaggaattccagtgttgtgctggctttgccccaggacacctccttagccctcttcctgagtctagagccccgggggttggaagtcctggcccctgggacacctgcagccacactcagcttctcctgtgagcctccagcatgtcccctcaggaccaagccctcacgttcttgcctccccgcccacctgggctcagccaggggaaggcctggctgggagcgtctcccctctgccctgcccttctcccctcctaccctgcccttctctcctctgccccgccatggcttttatatcctgtgccacaagacatggctgtgtgtgaaagtggcagggtctggcatctctgtgggtctctgaggcccacgctccagtgccactcttcccacccgctggccgtgccctcatgctggagggacagcccagccctctcccgaaccccagccccatgtgcccagctgcccccggccctctcccctggaagccggggtcactccagccgtatgccatggtggggacatcctgcttccttggccttccagggaaggtcctctttccaaatggcgacacctggtccctgcctggaggctggaagctgtggcccttgtatgcccctccagggtctgtgcgctcggttggcccgagttcccatcaccgtcatcatcaccatcatcattgtcatttcgcttgtctgtgagccggcctggtctcccagagcagagaccctctgaggtccagcctgagttggggtctccgtgctgacccctgacggggactcaggacgtaccaggtctgggtcaggagtgacccccaaacctcgtgccctttgacaggcacccctgacttttgctaagtgggtggaggtgacatcacttacagcgggagtgatgggacagggtctgttggctgcactgtgctcccagggatctggggagaggctatatccctgggctttggcactgcagagctgtgtgtgtttgtgtgtgtgtgtgtgtgtgtgtgtgtgtgtgtgtgtgtgtgtgtgtttgcgtgcgcgcacatgtgtataagatctttttttattacatgaagcaagataactgttgctgtttccttttgggttttgtgttcaacagagtggggtacttcttccctcagacaacagaactctcccctttaaacacgtgctgtcagagggtgggtcttgggctcatgtctgtttgcacagccgagtcagaggaaacacagggttcttcataaaaacactgcacagcaggcgactgtccagagtcagcctgcaggacggcagcagccctgcccctcagagcacagctagggtgggctgctttgggatctcccgtcattccctcccagctggcagccggcggccggcccattccttggtgtgctggtcaggggggcgtgcgcctgctctgctcaccctgggaatgggacagaagctggcagctcggagaggacagggctggacccttgggtggcctctggctggaccatctcattgtcctcagacacagcctctcgggtctagtttcatttcctgaaaaacaagtgcacagaactagagcaggagtcgagagctacggcccccgggccagatccagccctgccacctgttttcacaccatgctcaagctgagtgggttttacattttttaattacttgaaaaaaaaaaagccaaaggaggtttcatgacccatgaaaattatatggaattcaaaaaaaaaaaattatatggaattcaaatttcagtgtccataaataatttcttgagacagggtctcgctctgtcacccaggctggagtgcagtgctatggcatggctcgctgtacccttgacctcccaggctcaagcgatcctcctgtctcagcctcctgagtagctgggactacgggtgtgtgccaccaagcccggctaatttttttttaattttagtaaagacagggtctttctatgttgcccaggcttttctggaactccatcttggcctcccaaagtgctgggattacaggctcgagccacggagcccagcctgtttttgttttttcactgataaagttttgccgggtgtggtagtgtgtgcctctagcgatttgggaggctgaggtgggaggatcgcttaagcccaggagtttgaggctgggctcaagtgatcaggaggtgaactatgatcatgtcattgcattccagcctgggtgacagagcaagaacctatctcttaaaaatatatatttaaaaagtattgggtgtggtggctcacgcctgtggtcccagctacttaggcatctgaggtgggaggatggcttgagcccaggagtttgaggttgcagcgagccaagatcgtgtcactacactctagcctgggtgacagagcccagaccctgcctctttaaaaaaaaaaaccaaaaaacatgtattggaacacagccatgcctgttcagtcacgtgctctccatgctgctttctgctccagagacccttatggcctgaaagctgaaaatattttctatcctttacaaaaaagtttgctgacctctgtcctggaaaattcatctcccaagttctcttccggcactggcgttcctgggtgtcctaaatttggcccctgttatttctgaactctgttttggctctgttccctcccaggagccaggacaggcacgttctctgcatcttgtcccctgacgcccagaggcttggctcggctcaggcattcttggaaatatctggctccaggaaaggcagaggcctcctgagtcggcccagagggaacctgccccaggtctgggggaggcctgacccagcagagtggcttttgccgatgggttgggccggtcaagatgtgctgaaagttgtcctcagaaggccactttgggattccttcctccagtattagagcaactgagagctgctcattgcaagcctgatgttttcccagttggccgggtccaccgggtgccctgggattctgggatctgggtggaaagtagggggcttgggggagtgtcctgggttctggaatccaggtggcaagtggtgaggttcagggagtggcttctgagccaccataggggtctctgtgggaggctctgcccatccaggagattccgcaggccctgccggcccagagccagcgtcttgcgcttgccgaggctacagccagccccagccgggtggaacagcccgtcgcctcctctcactttgttttggggccacctgggagtgtggagcaagggtagagagggaggaagtggctgccggccgctgcccagcacccttgtttgccttgggccctctgtgggctcctttttattgctcttcaatgaagccagggaaatggacttccttgcctcacttcagttcaacatgtctggaagtttggtattaaaattaagaaagtgtggaaatagagcaagaagagaaaaatctctccaagagataatagtgacctctgagctgggcgcggtggctcacgcctgtaaatcccagtactttgggaggctgaggcgggcagatcacctgaggtcgggagtttgtgaccggcctgaccaagatggagaaaccccgtctctactaaaaataaataaataaataaataaataaatacaaaattagccaggcatggtggcgcctgcctataatcccagctaaggcaggagaatcgcttgaacctgggaggcaaaggttgcagtgagccaagatcacgccattgcactctagtctgggcaacaagagtgaaactccgtctcaaaaaaaataaataaataaaaaataaaaatagtgacctctggccaggtgtggcagctcatacccgtaatcccagcactttggaaggaaggccgagatgggcagattgctttagcacaggagtttgagaccagcctggccaacatggtggaaccccatctctacaaaaatagaataaaatttaagaggtaatagtgaccttttggtagatcgaaacctggattgctttctttttctaaatgctgattcttttctttgtggtgtttgtgttctgtgccgatgtccctcccccagccctgttattgtgagtggaagaaggggaaagggttcgcccgctactgtgagcccctcctctcacgctgggtgtccttggagaagcctgcacttcttcattgtacgccagggctgggtccctccctggagtggttctgtgctgctgggatggggccaacccctcagatgttttctgagtgtcacacacaggtgtgtgcattcatggcctttgcgtgtcttcctgttgtggaggcaaaaatgtgaagaaccctagatgattttgggaccagggctccatcacctgctgttcattgcacaccggagcatccaggcatgggtggagagctcagacttccaggcacggtcgcaggggctggtctaaccatgttcccgcccgcctgctcgtcagaaccgcctgttgggagctgttatcatgataccatacctgggccctgggctatccgattctgacttaattgctccaggttggggccaggccgttgtttgctgttttgttgtttcttctgtgacgttagccactgggctaatctgagcccctcagttacaggtggagaaactgagacccatgggggtgcaaggacttgccgaggacccagagccccttgggggcagagctgaggcggggcctggctttgggtcccagagcttccagtccccttcccgctctcctaacagcttttttttttgagacaagatctcaccctgtcacccaggctggagtgcaatggcatgatctcggctcactgcaatcttcgctagctgcgttccagcgattctcctgcctcagcctcccgagcagctgggattacaggtgtgtgccgccatgcccagctcgtttttttttgtacttttagtagagatagggtttcaccatgttggccaggctgatctcgaactcctgacctcaaatgatccgcctgcctcggcctcccaaagtgctaggattacaggctgggatcacactgtgcctggccctagcagctttgtcctgtgccatccaacaacagatgaccgaagtctttgtttcttaacatgcattccatctgccttacagttttgccacctgcaaaacagaggacttgtcgcttttctggtaagctggaaatgtaatctggtagcaggaggcctgtggaagcttgcctttaatggccttgtgtctctttcatcctgtcctgagagccggagaacttggatgttgcacctaactcaaccttcctgttaacatacagttctgcaggctcatggatcatcagaaccacgtcctatctcacgcggctgtatgcttccgttggttcaggtgtttttaccttgacagtattttctcctcggtggcttttgcggtggttgcttttaatcagcattgactcttcaagaaaaatatttagctgctacatctcagaggagacagggtggaaagcatctgagacctgcaggctcagacttagaaccagaagtgccctcagagttcatccggccctgacccagcgggaaatgagttcacagagaagcgggagaactttgccccaggccctgccgttgctcataactgccccaggtccttacatttgctccaggtcctgccccaggccctgcagttgctcataactgccccaggtccttatatttgctccaggtcctgccccaggtcctgcagttgctctgtgtggtgggtgtgatctggagccctccgcccattgctgcacctggggcaggcattgctaattgatcccaggactccttcctgcggagcacgccctggttctccaggcagccgctgcctgtcagcctgcagtggttcgggagaggacacctgcttgcctggtctgttccaaatcttgcttctcatcccagcacaggtagggggtgctatgggaaagggatcctcagttggccctgtcactgctctatcagctggggacgtggcatcctagtgaaaacatcatggccgggcgcggtggctcacgcctggaatcccagcactttgggaggctgaggagggtggatcacttgaggtcagaagttcgagaccagcctggtcaacatggtgaaacccatctctactaaaaatacaaaaattcgccaggtgtggtggcgggtacctgtaatccgagctactcgggaggctgaggcaggagaatcgcttgaacctgggaggtggagcttgcagtgagccgagatcttgccactgcactccagcctgggcaacagagtgagacgctgtctcaaaatctcaaacaaacaaacaaacaaaaaacaaacaaacaaagcgtcatttatccagcacccctggggaaccatgctacctggtgttttatggtacctggcaaggtgcaggtgaagttgctgctcttgggcattgaacccgtcttgtttggggcagctcaggccccaggcagggtccgggttggctctcgttggtgtggccctggcccatccagacctatatttctgccgtcctgcaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggtgagtccggggggtcccaagccatggctcagccatgcagacttgcatgaggaggaagtgacgggtccatgcctgggcataagtgttgagctcaggtgccccgacctggggaagggcaggacaggaaaggtgacagtatctggccaaggacagatgggaagggaccaagggagctgattagggagtggttatggactaggaatgtcggtaacaatggttagaaagtgactaacatttgttgagcacctgctgtgtgcccggccctggccgggagccttcgtgcccacagtgaccccgtctgcaaatgtagttccttgccctactcgcactggggagcaggacgcagagccgtgcaactcacaggtgccaagctcaggactccctcctgggtctgcctgggctgggctgtgcttgttgcccctgtggcccacgcatgtgcaccttccacctgaaagccaggatcttcaggacgctccccgaggaggtcgttgtctggcacaatgatttgtctcttcctgaaaaggtgacagagttacactggagagagcagcatccaggtgcggcagggacaggcctggggctcgcgggcagggactctgtgtcctgccggggtcccacactgcacctgcttgtcagaggcactcagtcaatctttgctgatgaaggatgagaggacagaggacgtgatgcttgctgctgcattgcctgcagtcctgggtgagatgcccgggttgactctgctgcccgtcgggtggatgtgatgtcagatccccggctttaaaatacgagggagctgggaattgagggagcaggttggggcagaaagcacagccccgtggaagcctggagctgaggcagtgtgggcgacccctggagcagtgagtgcttccttcatggccttcatcgcaccctgcagtcctcatgtaggggatgccatccatgaatttagttttcccagcctcctttaaaaacgcgttcatgctggggccggggcagtgcagtggctcacatctgaaatcccaccactttgggaggccgaggcgggtggatcatgaggtcaggagatcgagaccatcctggctaacaaggtgaaaccccgtctctactaaaaatacaaaaaattagccgggtgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaagtacaaaaaaaaaaaaattagtctgggtgtggtatcacgcgcctataatctcactactcgagaggctgaggcggagaattgcttgaacccaggaggtagaggttgtagtgagcccgtatcgtaccactgccctccacctgggcaatagagcgagactctgtctcaaaaagaaaaaaaaaaaaagaacatttatgccaggtgtggtggctcatgcctgaaatcccagaactttggaagactgaggcaggaggatcacttgagcccagaaatttgagagtgtcttccctgggcaacatagagagacctcatctctaccagaaaaaaaaaaattagcccggcatggtggcatatccctgtggtcccagctacttagggggctgacgtggcaggatcacctgagtctggaggcagaggttgaagtgagctgagatcatgccactgcactccagcctgggtgacagacagagaccctgtctcaaaaaaaaaaaaaaaaaaaagcatttactatccaccatggaaggtgagactgacctgtgagtgattgttcaaagaacaaaaaataaaccccagagataagacaaaagggtgcctccatgggggtgtgatttaaagctgagaaattgggcttcttccccctcccctctcaccccgtggtttgctaaaggagatgggaaaaaggattctttttttggctgaaatatttaacactaaattaaagccaattttaacagcactttggttgatgagtgaaattaacagactggccaaaaataaacgaacggtctgtactatgtgaaaaagaggcagctttggccatgctgggccaatgtgagttttcagggttgctgggaatgtctgtgaatcggaggaagggcctagctgggactctcaggagccaaggccctgaggggcaacttgcctggtccctgccctgaggcgttcactgctttcttcctgggccagatcacaggcccggaggctggaccactgggctggcactcttgccgagctgctccctgacttcctgaccatgctcctttcagcagccttgctgcactttagtttccttgaatgaaaaatggggatgagaatagctcctacctccaaggtgaatggagtgagttcggacaggtgactccctgggaccagtgcctggcgcctgacaaggtccagtcagagcccgcactgctgttactgatacccttggctgtaccaggggagaacttggttgccattgccaggtgttctcccaccacccccactactgtccctgtttgatgtgtggcgggaataaagctgtgcacattggagcttttggcacatcctggctttcaggtgaaaggtgcgtgtgtgtttgagggtttagcctggccaacccagccatgaggtcggacctgacctgggggtgagtcctgagctcggcacccctgagctgtgtggctcacggcagcattcattgtgtggcttgggccgcacccctttccctgctgggctgttgatgtttagactggagcctctgtgttcgcttccaggaaccaacccgtgtgcggacaggaacggggggtgcagccacctgtgcttctgcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaaggtagcgtgggccagaacgtgcacacaggcagcctttatgggaaaaccttgcctctgttcctgcctcaaaggcttcagacacttttcttaaagcactatcgtatttattgtaacgcagttcaagctaatcaaatatgagcaagcctatttaaaaaaaaaaaagatgattataatgagcaagtccggtagacacacataagggcttttgtgaaatgcttgtgtgaatgtgaaatatttgttgtccgttgagcttgacttcagacaccccacccactcccttgtcggtgcccgtttgctcagcagactctttcttcatttatagtgcaaatgtaaacatccaggacaaatacaggaagactttttttttttttttttgagacagagtcttactctgttgcccaggctggagtaccgtagcgtgagctcagctcactgcaacctccgcctcccaggttcaagcgattcttctgcctcagcctcctgagtagctgggactacagacatgcaccaccacacccagctaattttttttatatttttagtagagacagggtttcatcatgttggccaggctggtcttgaactcctgacctcaggggaacagacggggttggcctcccaaagggcggaaataacaggggtgagccaccgttcccggcctaggaaaactttttgccttctaaagaagagtttagcaaactagtctgtgggctggccttctgattctgtaaagaaagtttgattggtggctgggtgcggtggctcacacctgtaatcccagcactttgggaggccgaggtgggcagatcacctgaggtcgggagttcgagaccagcctcaccaacgtggagaaaccccgtctctactaaaaatacaaaaaaaaaattaaccgggcatggcggcgcctgcctgtaatcgcagctactcaggaggctgaagcaggagaattgcttgaacctgggaggcggaggttgtggtgagctgagatggcaccattgcactccagcctgggcaacaaaagtgaaactccgtctcagaaaaaaaaaagtttgattggtgtaaccaaagcgcatttgtttatggattgtctgtggcagcttttgttctgccgagatgagttgtgacagatctgtatgggctctaaagcctaaaacatgtgccatccgcccctttacagaaaaagtgtgctgacctctgttctaaagtattggacaactacaatgtttgctcatttattattctatgatttgttttctgctttttgttgttgttgttgttgttgagatagggtttccctctgtcactcaggctggagtgcagtggtgtaatttcagctcactgcagcctcgacctcctgggctctagtgatcctctcatctcagcctccctagtagctgggactacaggcacacaccaccactcctggctgattttttttttttttttttttttttgtggagacagggtttccgcatgttgcccaggctggtttcaaactcctaggctcaaacacccacctcagcctcccaaagtgctgggattacaggcgtgagccaccatgcccagcctattctactgtttgtattacatagctttaaaagattttttatgactttaagtcacaagggttctttgtagaaaaaaatatatatataggaaagtataaaaagaaagtaaaaattgtccataacctctccagccagagacgaccgttgctgacacctcagcatattgcctttaagtcttttttctctaagatagcatttctcttcatcacagtcatatgctacgcagaattctgtatcctgattttttcacttgacattacaacaggtatttgatggcgctgtgacaaactctttggcacaatcttttaaatgtatgaaatactccactgcacagatgtttgcttttaggcttaactgttcttttattttgcgtgtgctggttacagccgggcacagtggctcatgcctgtaatcacaacactttgagagggtgaggcaggaggatcacttgagcccagaagtttgagaccggcctgggcaacatagtgagaccccatctctacaaaaaacttttttaataagtcgggcgtagtggtgcatagctgtagtcccagccaccaaggaggctgagttgggaggattgcttgagccccaggaggttgatgctgcagtgacctgagattactccactgtactccaacctgagcgacagagcaagacttgtctggggaaaaaaaaaaaaaaaatatatatatatatatatatatatatacatatatacatacacgcacacacacataatataaaaatatatatttataaatatataatatataatataaaaatatatatttataaataaaatttataaattatatttataagtaaatatataatatataatataaaaatatatattatataatatataataaaatatataatataaaaatatatatttataaataatatataatacatacttataagtatatatttaaaatatatgtaatgtatattttttaatgtatgatatataatatacatttataaatacacatttatattattttatataaaatatatataaaatctccaagttgctttttccaaaaaggtgtcttgctgcatttcaaacattcatttaaaaacttgaatgctggtgatctggtccagaatgtgttcagtagctgctgccagtggccaagcatctcgggagatgtctacaaaacacgctggttctggcctggcgtggtggctcacgcctgtaatctcagcactttgggaggctgaggcaggtggatcaactgaggtctggatttcgagaccagccttgccagcttggtgaaaccccatctctactaataatacaaaaaaattagccaggcgtggtggcatgtgcctgtaatcccacctacttgggaggctaaggctggagaatcgcttgaacccagggggcagaggttgcagtgagccgagatcgcaccattgcactccaggctgggcaagaagagcgaaactccgtctcaaaaaaaaaaaaaaagatgctggttcctaaaatgtggcccttttcctcctcacctgctgccagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaaggggtaagtgtttgcctgtcccgtgcgtccttgtgttcacctcgtatgagacagtgcgggggtgccaactgggcaaggtggcaggctgtccgtgtggccctcagtgattagagctgtactgatgtcattagccttgatggtggccaggactggtagggccctcagaggtcatggagttccttcgtggagcgggtgctgaggctgtatcaggcacagtgctggctgctttcacctgggccgtctcaccgaagtgtccatggagcctgcgtagggtgggtatctgtgtcgattttacagatgcagaaacaggctcagagaaaccgagtgacttccctaaggtcacatacccagttagagcagagctgggccaggaagtgctgtctcaggctcctgaccaggtctccttgctttgcactcttgccaaaaccatgatccagaactgactttgaggtccccggacctcaggctcctccgaaatggcctcttggaggctgctgagccacagcttaggacccacctcgagaggcaaatgtgctttgagctgccaggcgtcctgggggccctgccttgggcacggggttcagacaggccccagatgtgtggggcgtctttctggacttgagttttcttttctgtgtggtggacacagtgctcaccccttaaagcacctgtgatgtgtgcagcagcccaatccctgcctgtcgcctgttctgctagggaaggaaggaatacttcaggatggcaggacaacagaaagaggtccaggttttagagcaagggcaggtcaaacttagaaaattctggaatgaggatgtgcatttcctcttctggatctgctaaaagaagagggaaggaggggctgctgggggaggagcccagagccgagtttacatccggatcccgcaaggcctcccctgccctgaggtcttgttttgtgatgtgcttgtgtccatcctggtttctgccgtgtccccaacatccggccaagcttaggtggatgttccagcacacactcaccctgtctgtgcacctgtttttgtgtccgtaagtgggtatttactcaccttacgagtgagccactgtgggaattcagggaggtggcgcagtgaccacccctggagggatatgtgtgtggcaggggtcgagggtctcgcccttccctgcttcctgcgcgtggctttctccaggacggggagggctgagctgaagaggtggggacagttgcgtccccccgccacccactgtcctgcggtgagagcagactcactgagcctgcccttctcccttgtgccttccagctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtgagggccgggctggggccttctggtcatggagggcggggcagccgggcgttggccacctcccagcctcgccgcacgtaccctgtggcctgcaagttccccaacctggcaggagctgtggccacacccacgactgcccagcagcctcaccctctgctgtgggagttgtccccgtccacccctgggtgcctttgctgcagttatgtcgggagaggctctggtgacagctgtttcctgtgcacctgctgggcactaggtcccagctaatccctgtgccaggactctaatttcaccctaacacacatggtggttttcattgctggggaagctgaggcctgagcacatgacttgccttaggtcacatagctggtgagttcaggatcccccagagataccagggccagcactcgatccccacccagccctgaaccccaccatgtgctgggattgtgctgggagtgtccacacgcctgggaccccagggctggtgctctcatctcctttttccagatcatgagaatgaggctcagggaagtttgaaaaaaacctatcccaagtcacacagcaacaggagcaggatttgaacccagaaaaggggaccgcacactctgttctgctagagtagttagctgtcctgggtgatatggcaggtgacaggggcaactgtgcttaacaaaggaacccccatcccccctgccaagttgggagactagaaggtcaggggcagaagctctgaagggccaggtgcagtggctgacacctctaatcccagcactttgtgaggccaaggcgggcagatgatttgagcccaggagttcaagatcagcctgggtaatgtagtgagacgccatctctacaaaaaaattttttaaaaattagctgggcatggtggttcatgcctgtagtccaagctacttgggaggctcaggtgggaggattgcttgagcccaggaggttgaggttgtggtgagctgtgatcatgccactgcactccagcctgggcaatagagtgagaccgtctccaaaaaaaaaaaaagaagaagaaaaagaagctctgaggctccaagtccccaggcaccccttggcttgagggcagacaagggaggagagggtcacctgggcagccctgacttttgtcccctggcaaagggaccttcagtgaccttggccctaggagagcctctgagcacgtcagccatgtcgaaccgctcaggaagggcagcaagaatttggcttctgacctctgcctctcctactcgccatctgcactgggtgtggttgtgcccattttacagatgaggaggctggggcatcgaccagctgaatgccttgtcccaggtactgcgtaggcagagctggcagttgaaccccgtgtcctggttgtcgctgggggtgggctgcaccctgacttgtgaggccagtagcaaggtttgcacgtgacttcgtgaccgtcacccagctctgcagcacatcccgtgacccagctcatccaggccgcatgcaaacctgttgccaggcgagaaaccagtcaccgcacagctgtggttgcctgaaatgattaagctcattaatcaccccggagtgaggacagactcagatgaaaaccagcaaaagccctggaaactcatgtgaccctgccaatgagggcggccatgtgcattgcagcctggccgtcactcctcggtacgtgttttggacttaaacgctccggatgtttactgagtgcttgattaataacatggaaggcctggtctcattgctgtgggagtgaaggatgcacagccaggcctgacatgatgagaacaagaacctggagtctcgctgcctgggtggtaatcctggccctgccacttagcaactgtgtgactgtagccaggtcacttaattttgctagatcctgcctgcgcttcagtggatcttgctggttttccaaggtggccaaacactttaaggcattcatgtggtcgctaggctgcagggttgaaccctggctcaccccgcagggcgccgtgtgctctgtggcctggctgtgcctttgctgacaccgtgcccgtgtgtgttcatgcaggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagccgtaagtgcctcatggtcccccgcacctcactccctcgttagatcaggctggttctgggagctgacgctgaaaggagcttctcatctggggttcctgggtgtacatagatggttgggtaggttgtgcactgcacaagctgcatgatgctacctgggggtccaggtccaggctggatggacttgttgcttcatcaggacatagataaatggccaaaactcctcagctggaaggtcctgggcaggatctttgggtgtgaaaaccagtcacaggggaagggtgcttgctcatactgccagcacagtgctgagtgctttccatagcgctcgtttactcctcaagcctggagggtggggagtagcatggtcccatttcacgtacaaggaacccgatgcacagagaggtgtggcaacccatccaaggccatacaactggggtgggttgagccggggttgactgtggcaggctggctcaagagtccctgctcctgaacccttgccaggcagcctggcatcagctcggggaatttttgccctgacccttggaagcaagtgggcctctttgttctcatgtcagtgatgagaagagtgactttcctatggcccctctggagtacaggtgtttcctgttggcgggctcttcccccatgacatcagcagcgagctggttatgattccctacgcagaacttgatagtttataaagctctttgtcatccaggccccgttggagtctcacgcagacctggtcgcaggcggggctggtcttgcctgtcccagctgcatggatggggaacttgaggcttgcaaaggttaaggggctgttcgaggcccacgctggcaggagatgggcctgggccagagtctgggacttcccatgcctgggctgtctttggtcctgttgctcaccatccctccctggggccatgaccttagagagccaaatggaggtgcaggtaacccacggcaaggaggggttgccatgactcagagtccccgtcctgtggccggcagtacctggtgcaacgacttggatttcagaccagccactgtagcccgctgacggtgcgctcgaagtgccacagcttctgaagccaggcaggactcaggccaggagactctgttagctgttgagagggagaggccaacggatgttctggttctgctagagagctggttcttcggatcctggtaccagtgcactgagaggaggcccagcttgattctggggctgccttgtggtggcatgtgctgctcactgacaccctcgaggagtgtcttctctcgggcttgttgactgtgcccggttttccgcagttcactggtgcacacataggcacatagcaaaccgcacacacagtcgtgggtatgagtttcactacattccaccaccagtgttcactaccattacctgccttccgtcttaagtgttcatcatttaaaaataaatttattgggctggacgcggtggctcatgactgttatcccagcactttgggaggctgaggcgggcagatcacctgaggtcaggagttcaagaccagcctggccaatatggtgaaactccatctctactaaaaatacaaaattagctgggcatggtggggcatgcctataatcccagctactcaggaggctgaggcaggagaatggcgtgaacccgagaggcagagcttacagtgagcccagatagcaccactgcagtccagcgtgggcaacagtgcgagactccatctcaaaaaaaaaataaataaataaaagaaaaataaatttatgatctatttcaaaaataacacatgtactttgaaacagcagagacacatatgacacggagaatgaaattccccatagcgcacccccaagagacagccctggtccccccgtctttcccgtggacctccagcggggcagatgctgagccgcctgttgtcgagtggcatgctatcccgtcctccagctcctctgtggcttacagacacccacctgcagccctgtctttgcctcctctagcgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccaggcaggtgccctgtgggaagggtgcggggtgtgcttcccaaggcgctcctcttgctggtttccaggctgctgcccctgtccttagcagagggaggaaacagaggatggctctgggtgaatgatgacttgggcttcgattatgtagtcacagggtatgaccctgagatgcgtggaaccccgagactgtgattatatgtagaaactgggtttccccgttgtttaagtagtcatggtggggtcagaccccacaggacttttgtcttttcaagaaagaaaatggtcgtgtgtcatgcaggggtagttggtactggttaatccaggtttatcctttattttgtgggaactgtacagtcatttctgctacaatgctgtatatgctcttctgaaagacacctatgcaaaatcgcacagtaaaaatgacacaactcatagggaaagcggggccagggcacagccctcaaaatctccatcaatgacatgtaagaaaagagaggaacctgggaaatagcaaagtgccttttgcacattaaatggttagctatatcccacaatactgtgcattcgtaaacgttaatgctgcaataaatacggcacttcaccttgggaagatctggagttggcttatgagtgtggaagggtgtagcgcatgagtttttgtgaaacactggaaggaggattgtgggaaatcaaatggaaagttctcaccccaggcgtggagaagagtgggtcatggccccagcagtgagcccagggaggtcagagacggaggtgtgtgtgtgggtgtgaccctgcgcagttccctgccggctgtagttttttgcattcgcttaatgtttctcgtggaggaaattgtgcatgagcaaatgtgaaaccgtgctgtgctcaaattgtcctaatacatcattgcattggaacagattggctttnttttttttttttttttttttttttttttgaaatggagtctcactctgtcaccagcctggagtgcagtggcatgatcttggctcactgcaacctttgcctcctatgttcaagtgattttcctgcctcagcctcctgagtaactgggattacagggcatgagccaccgcggccggccagatttgcatttttgaaacaactgctaggctgggcgcggtggctcacacctgtaatcccagcactgtgggaggccgaggcaggtggatcacctgaggtcaggggttcgagaccagcctggccaacatggtgaaaccccgtctctactgaatatacaaaaatcagctgggtgtggtggcgggtgcctgtaatcccagctactcaggaggctgaggcaggagaattgcttgaacccaggaggcagaggttgcggtgagccgagatcacaccattgcactccagcctgggcaacaagagcaaaactccatctcaaaaaataaaaaatagaaaaacaagtgctgtagcggaagtgagcactttgcggagtcaggcttgtgtggcctgttccacaaatgatgtgctcacggtggcctcaggcccacctggagtctgcagcatggggcacaacaggttcattagtgtagaattccaggacaggcctggctcctaagcagccttcttttacaaaaactgcagagcccgcctgtatcgtagcactttgggaggccgaagtgggtggatcacgaggtcaggagttcaagaccagcctggccaacatggtgaaaccccatctctactaaatatacgaaaattagctgggtgtggtggcacgcgcctgtagtcccagctactcgggaggctgaggcagaattgcttgaacctgggaggtggaggttgcagggatctgagaccatgtcattgcactccagcctgggcaacagagcgagacgccatctcaaaaaaaaaaaacctacagagccacacggcctctttctccaccgagtgttggtgtgggagcttgtgttattgtggtgaaatcttggtactttcttgaggcagagagaggctgagcgcctggagagactttcacatgggtcgccatgtccgccgtcggtttcgctgttgtgctccccatctgaaggctggtgccgtccagacaggctggacgcccctttccaccagatccttcctcccgcagcagtttctagttacgttgtactgtgaggtctgtgtccttggttgatggcaaaagtcagccgaattgaaattcagagccatgcctggctccctggagcttctctcctgggcagctgtgatcattgcctctgctgtggtgtgggtggtggaaatggattcctttcatcttgcttgctacaggtgactgtcacgtggagtcctttggagagagggacgtgttaattgatggatgtggctcccatgctgagaaagctcctgggcgtacattgccttagagtttcattggagctgcgttcttttatggtgtctgctaggcagaagtgatgaagacttggaagaaaacccagaaggttttccacttaatttggaaaatgtgcttttcccctcctgtgtcttttgctaaggtccagcctcctgcagcctccccgctctgtggactctggctttgattctttattaggagtccccctgctcccccaaaagatggtgtctaaattatcatccaattggccgaggttttgttttctattaattgtttttattttttattgtggtaaatttatataacataaaatttgccattttaattgttttgttattgttgtttttgagacagggtctcaccccagtgcccaggctggagtgcagtggtgcgatcatggctcactgcagcctcagcctccagggctccagtgatcctctcacctcagcctctctagtagccgggactacaggcatacactaccacatctggctgattttttgtattttttttttattgtagagacccgctatgttgcccaggctggtctcaactcctggactcaagccatcctcccacctcaccctcccaaagtgctgggattacaggcatgagccacaacacccagccattttaatttttttttttttttttgagatggagtctcactctatcgcccaggctggagtgcagtggcgtggtatcaactcactgcaacctctgcctcccaggttcaagcgactctcctgcctcagcctcctcccgagtagctgggattacaggtgcccatcactatgcctggctaatttttgtattttttagcagagacggggtttcaccatgttggccaggctggtcttgaactcctaacctggtgatccgcccgcctcggcctcccaaaatgctgagattacaggtgtgagccaccgtgcccggcctttttttgtttttgagacagggtcttgccctgtcacccagactggagtgcaatggtgggctcttggctcactgcagcctccgcctcccaggctcaagttgtgcacctccacacctggctaactgtattttatgtagagacagatttcaccatgttgcccaggctgggcttgaaatggactcaagcagtccacccacctcagcctcccaaagtgctgagattacaggcgcgagccaccgcacccagcccattttacctattctgcagttgacagttcagtggcattcagtcagttcacgaggtaaccatcactgccattcatctccagactacttcaccttctcggcagatgtccgaaactgtccgcattgaacacactcctcatctccctctgacagccaccattctactttgtatctctctctgccttctctaggtacctcatgtaagtggaattataccaatatttgcccttgtgtgactggcttctttcatgtgacatggtgtcctcaaggttcatctgtgttatagcctgtgtcagaatttccttccttaaagcctgaataataacccgttgtaaaggctgggcgcggtggctcacaccctctaatcccagcattttgggagtccgaggtgggcagatcacttgaggtcaggagtttgagaccagcctggccaacatagtgaaaccctggctctactaaaagtacaaaattagctgggtgtggtggcgcgcacctgtaatcccagttactcaggaggctgaggcaggagaatcgcttgtacccgggaggcagaggttgcaatgaaccaagattgtgcctctgcagtccagcctgggtaacagagtgagacttcctgtctcaaaaaaaaaaaaaatcatcggatggatggacggaccacttcttgttatttatccatccacgggtgctaggtttcttccacctttggttgtcgtgaataaggccactatgaacatttccttccgtggtgaaggttttgtactagtgaggaaaaggcgtgtttgtggtgttgcataggattctggtaagaaagtttgcactaaccataagtatttgtactacattaaaatgaaagctcaggggccgggcgcggtggctcacgcctgtaatcccagcactttgggaggccagggcgggcggatcatgaggtcaggagatcaagaccatcctggccaacatggtgaaaccccgtctctactaaaaataccaaaaaactagccaggtgtggtggcgggcacctgtagtcccagctacttgggaggctgaggcaggagaatggcgtgaacccgggaggcggagcttgcggtgagccgagatcgcttcactgcactcgagcctgggcaacagagcaagactccgtctcacgcaaaactctgtctcacgcaagactccgtctcaaaaaaaaaaagagttcagggtttatgaaactggccagccgcgtaaagtttgctgtgttgtttttgtgcccgggaggagtgtggccagggtgtcacgtcacacagtacacgtttctcagatggtggttctccagactgctgtcccaaagtctgtttttgcatctggttcccacagacccaccctccacggtgagcctgattttggccagggtagctggaatcttgcttgtctttcagcccggcagctgtaccagtccagggtccacagctagtggcttttaggaaggaatttgttcagttggctttgacacatggccccctagggtccacagctctgtagtgatgtggatgttgttatctacaaagacacatgatccttcgtgtccagatgaaagtgatgatgtctttgcagctgcccagcaaggctgtgtgtgtgtgtgtgtgtgtgtgtgtgtgtgtgtgtggtgtgtgtgtggtgtgtgtgtgtgtatgggggagggaggcaccctttccatctgggggtgtgtgtgtgtggggtgtgtgtgtgtgtgtgcgcgtgtgtgtggtgtgtggtgtgtgtgtgtgtatgggggaggcaccctttccatctgggtccaagagactgggcctggggaagacgcttctttttatctacttagagactttgttttatttgtatttttttgagacagggtctcactctgtcacccaggctggggtatggtgatatgagcatagctcactgcagcctcggcctcccaggctgaagcgatcctcccacctcagccttctgaatagctgggactgtaggcgtgcgtcaccatactgagctattgttttttttgtttggttggtttaattttttttgatacagatggagtcttgctatgttgcccagactagtctcaaactcctgaactcaagtgattctcccacctcagtttcccgacattctgggatcacaggtgtgagccactgctgtctccctgttttattaactgctgaaagacctagataaagaaagtctgaaaagacttactatcagagcaccatcctaagatgattccctctgactcaatggagagggaggggagcttttccttcaggcctgggtggcaggagcccaggtgctccaggccccatttgccccaggccaaatcactcgggaacttggatgcagctgtctttcagggtaacccaaaggaaccagatccccgcaggcagtaggcttctgggctgtcctctcctcctacgtcagctcagtaagagcccttcgaagggatgctgtgtcggaggccccaaaagcccaggctcatccctgagatgcacagggtgggctgggcttaggcagcgctcgagcatctcctggacggtgaccccagagagtgtggagacggagagtccttgagagtcactgagagacgtggctgccctgccttcccaagaggggctctgagtcattccccacactcacctgcccctacccaccctcacctggcccccagcctcacctacccccacatctgtaccgatccctttacccgcaccttccctacccaccctcacctcccctgtaccttcacctcccccactcacccgcccctgcaccctcacctgtcccccaccttcacctaacccccaccctcacctgccctcccctcacctggcctccttccgttggggaaggggttgtaaggggcggcccccaaactgtctgtcctggtgccctgcagagaaaacagtacgtgagggccgcagtccaaaagcttgagtcctggaaggtggaggagacagggatgtgttgggaagggccccatggtcttggatcccttctcgactgtcaatggggccttcatgggagcgccagtctagtgatgcacagctgggtgcccggcgggtggctgaggaggcctaaagtccgaggcggcaagagctcttccagaggctgttgtcctaatcgctctggcatactcaggcgggcacgtagttaggagctgattggagaggagagacccccacaccaatactgggatttgactttcaggctaaacttgagaagtgtggcctctgctgtcctgccagagctctccagccagtgcccagggctctccagccagtgcccgggggtctccaccagtgcccgggggtctccgccagtgccaggggtctccgccagtgcccaggggtctccgccagtgctcaggagtcttggtttctttgtcttacagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtaggaggccaacgggtgggtgggggtgctgcccgtccaggcgtgcccgccgtgtcttctgccgaatgccagcctctcacaggctggggagactttccaccctggggatccaatgggtggctttccagggtcccaaaagcaaacacaggctctttcacagcccctccaggaaagcagaaagccccaagggctggaagggaagggggagctctgctgagaggttacaaggcagcgctggccgacgggagttgcagttgataggttttgtatcatccttgttaaacttgaaccctgtgcagaaatcccttccacggcatgggggctgcctgttgactcgctcctgttccaccacagggagctcctgggcttcttcctcccagaggcccccgacgctcccacctgttggtcgtcagagcttctggttggtgggaaggcacccaggaccttgaggtctccagagagaaaagccagggaaagagggagaccgaaacccatgtgacatgaaactcaggctccaaactgagcacgggaacgtttggggacaggagcgcgatggccttcctcagatagctggggggctggcatgaagacgggagctacagccagcacaggtcctgggccgggagcccagagattgagccctgactctgtcacttactggccacgtgaccttgggcgggtggcatagcctcttggagactcagtttcctcattggtaggagtgacggccacagtggtgcggcctctgcagcacacggggggctcggtgggcggaagccccgggtctataaggcggctgtgcaggagccagccgagctggtctcccaacagccagggctccggggtccttagcagctgtggggggcctgcacctgtttcccatggctgctgtcagaaattaccagaagccaggtggctgagagtaatggacacttgttctctcacagttcctgagggctgaagcccgagatcgaggtgtgggcagggccctgcgccctctgaaggctctgagggaacctttgggcttctggtggctccaggcaccccttgacttgtggtcctgtcactccagtctctctgtctggctgcacatggcgtggcctcttctgtaccattgaaggacacttcagttggatttagggcctaccctcacccattgtggtcgtatcttgatccttcatgacatttgtaaagaccctgcttccaaataagctcacattctgaggttctggggtgagcgggaatttggagagcattgttcaactagtatagaatgtgacctgtcagcctcgggcagccctgagaggcaggggctttccacagcccagctgggtgccctgggctccgtgctgtccgaggagacgccatccccacacccgtccttcacccgccaccctcccgcaggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggtacgcgccccggggcctgccctaaccgcagacacccggccttcattgtcagtaatggcagcagctgccacattgtccgagacctgccgtgagcccagtgccgcgccaggggctttgtgtgtagcgtgttttgtcctcacactgacagctgtaggctggggttctgagtgagccccacagggcagaggcagaaaatgagtctcagagagggtgagcgagctgcttggggccccacagcaggagatggagcaggactgcagcctagcctctgcccccagcacctgcgcaagaagctgctctgctctggactgtgttaggctgcgagggctggagagaaatgagagttggtgcttagagagggggcgcaggtccccatggcttttcctcttatgatgaggtagatgggtgaagggaggggccatgcttgcaggggccagtgaccgaggcccgccgttggaactgatggccttcatcccgagcccagcccaggtgggagcagggctttccgagggcttgtcttgggtcggcctgcttccagggactctgctgcagctcccacccctgtccaaagcatggaatcccccaggctccctggcagtcctgtcaacctctgtcctcccaagctgagtgtggggcaagttctggaggtcagcactgctcaggggggcccacgggctgcttgcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctgtacgtgggggctggcagtggggtgggcagggtggcctctaaacccgacccctggaggaggctggaggccagtgcaagatcctgtgtggcctcagccaggcggtggtctctgccagatgccaactgttgcccgctggggttcagcgacatgtccgaatgtcccgaggcctctgaggttgttttcttttgccgcagaacaaatcaccacgaacagcgttttaagacaacaccaactcttttttttttttttttttttgagtcaggatcttgctctgttgcccaggctggggtgccctggtgcaaacacagttcactgcagcctcgacctctgggcttaattaagtgaacaccttgcctcagcctcccaggtagctgggactacaggtgggcaccaccacacctggctaatttttttttgtagagacggggtttccccatgttgcccaggctggtctgcaactcctgggcacaagctatctgcctgctgtggcctcccaaagtgctaggattataggtgtgagccactggcctgacaacacccacggattgtctctcagttctgtaaggcaaagtccaggcacagcgtggctcacctgggttctctgctcagggtctcacggggccagaatcaaggtgtcaggaacgctgggccctcagcggaggctctgtggagaaattagcttccttgctcactcagcaggtagcagttgtgggatcgaggttctgttttctctctggttattggtcggggaccactctcagctcctagaggccaccccaggtccttgccccgtggccctctctgcctcagcagtgggggctccctgcgtcagtccctcccgcaccttgagtctctctgatttgcttctaaagggccctgtgattcggctcagccacctttagattaggttagcctcccctttgatagactccaagtcggctgattaataaccttactcacatctgcagaatcccttctgccacataaggtcatgacgccgtgctggggactggggtgggaaattacggggtcatttaggattctgcctgccactgccttgctgtgtcccagggcttgggggaggggcctccacagctgggaccacagtccttcctcccctccatggtaaccatctgaggattacttgagaccagcctgggcaacatggtgagaacccatccctacaaaaaatacaaacaaaaagggaccaggctgggcttggtggctcatgcctataatcccagcactttgggagaccaaggtgggctgatcacttgaggttgggagttcgagaccagcctgcccaacatagtgaaatcccgtctctactaaaaatacaaaaattagctgggtgtggtggcaggcgcctgtattcccagctactggggaggctgaggtgggagaattacttgaacctgggaggcggaagttgcagtgagccaaaattacgccactgcactccagcctaggcaatagagtgagactccgtctcaaaaaaaaaaaagggccaggggtggtagtgacaaagagaccctatcccaaaaaaaccgaacactgaatccttgagactgagtaaggacactgtgaaatttttctgggtggggcagggaacagagcgtcttctgtcatttcttccacctgggtgtggtcagctctccctccaagctgcctcctcttcttctcattgtccgggtgttggacacatttggttaactggatagaataacgcgagttcccagggacttggtccatttgctattttattttattttattttattttattttatttatttatttatttatttatttatttattgagatggagtttcgtttttgtcgcccaggctggagtgcagtggcgcgatctcggttcactgcaacctctgcctcccaggttcaagtgattctcctacctcagccttccaagtaactgggattacaggcacccaccaccataccaggctaatttttttgtatttttagtagagacgggttttcgccattttgcccaggctggtcttcaactcctagcctcaggtgatccacgcacctcggcctcccaaagtgctgggattacaggcatgagccaccacgcctggcaccatttgctattttaattcccatgtgtattagtgtcccacggctgctgtaacaaatgaccacaaactggatggcttaaagcaacagaaatggattcccccaatgtgctggagaccagaagcctgcgaccaaactgttgggagggctgtgcttcctctgggggctccagggaggatctatttgttggcccttccagtgctgtgggtgccagcgttccacacttgtggatgcgccgcctcaacctctgcccatcttcatgtgtccatctcctttgtgtctgcgtctttacctcttcttcttgtctgtgttgcctcttataaggacgtttgtcattgggtttagggcccacccaaatcatccgagatgacctcgtcttgagatccttaacctgcaaagaccctttttccaaaaaaaggttatgctcacagattctaggccttaagacatgggtgtatctttctggggggcactatccaaccccttatacaatgaaagacgggaagagggccaggtgtggtagttcacgcctgtaatctcagcactttaggaagctgaagcgggaggatcacttgagcccaggagtttacaagtagctaggcaacatgatgagaccccatttctacaaaaagtaaaaaaaaaaaaaaaaaaaaaaaagccaggtgtggtggctcacacctgtaatcccagcactttgggaggctgaggcaggcagatcacgaggtcaggagattgagaccatcctggctaacacggtgaaaccccgtctctactaaaaatacaaaaaattatggccgggcgcagtggctcccgcctgtaatcccagcactttgggaggccgaggtgggtgaattacaaggtcaagagatcgagaccatcttggctaacacggtgaaaccccatcaagatcacaaggtcaagagatggagaccatcctggctaacacggtgaaaccccgtctctactaaaaatacaaaaaattagccgggcatggtagcgggcgcctgtagtcccagctgctcgggaggctgaggcaggagaatggcgtgaacccgggaggcggagcttgcggtgagccgagatcgctccatgccattgcactccagcctgggtgacagagtgagactccgtctcaaaaaaaaaaaaaaaaagaaaattagccaggcacagtggcaggtgcctattgtcccagctacttgggaggctaaggcaggagaatggcatgaacccgggaggtggagtttgcagtgagccgagatcatgccactgcgctccagcctgggcgatagagcaagactctgtctcaaaaaaaaaagccaggcatggtggtgcatgcctgtagtcccagctactcaagaggctgaggcaggagggttgttcgacccacggagatcaaggctacagtgagccatgatcgcaccactgccctccagcctgggtgacagagtgtgaccctgtctcaaagtaagtaaataggaggagagacaagtgggcagttcagactgatggtatgggcacagtagagactggtgcagacaggctggcctgtgatgtcaagcaacttctgtaactgtttccggcatccatttgtgtgtcaatttccgtgtcagtaggaagactctgtaggctgccaagaggaataagtgggaggatcctcccagagaggccgggcctgcaggagggccagttctcatgagttcttatttggcccctaccctccaggctgtggttctgaggtgggagacagagcctgacctctgtttgtcttgttttgtctttgcagcagcccacccatgtgcccgtgacaatggtggctgctcccacatctgtattgccaagggtgatgggacaccacggtgctcatgcccagtccacctcgtgctcctgcagaacctgctgacctgtggaggtaggtgtgacctaggtgctcctttggggtgatggacaggtacctgattctctgcctgctaggctgctgcctggcatccttttaaaatcacagtccctgtggcatccagtttccaaagctgattgtgtcttcctttgccctcctttcttttctactatgtgcattcggtgctatgaattttcctctaagtactgcgtttcctgcatctcacaaattttgttacattttcattttcaggtagtttgaatatttttacacttctcctgagatgacatctttggctcatgtgttatttagaagtgttgcttagtttctaaagagttggggcttttccagctgtctctctgcaactgatttctaatttaattctactgtagtctgagagcttattttatatgatttctgttattttaaatgtgttgggtgtggtgtttttgttgttattgtttttgtgtctttttgttttgttttgcttcgtttgttttgtttttgagacagtgtcttgctctgtcactcaggctggagtgcaatggcgcgatctcagctcaccgcaacctctgcctcccgggttcaagtgatcctcttgcctcagcctcctgagtagctgggattacaggtgcacgccaccatacccagctaatttttgtatttttagtagagacggggtttcaccatgttggtcaggctggtctcgaactcctgacctcgtgatccgcccacctcggcctcccaaagtgctgggattataggcgtgagccactgtgcctggccattaggtgtgttttatcacccagcatcatgcagtttatcttggtgaatgttctgtgtactcttgaaaagaatgtggattctgctgttgttgggtggagtgttccagaaacatcaattagatccagttggttaatagtgctcatcaggttgtctctatccttccttcctgactgcctgcttgagctgtcagttattgacaggggtgtggagtctccaactctaatggtggatttgtttatttctcctagtagttctatctttttctctccttctacccttgatcctcttctccccctagggcttcctggtgttggtggtgggagagtggggtagtgaagaacctggactttagggccaaagaggccagggttcaaatcctggctctgtcacttcccagttgagtgaccctggctggtgcctgaatctctgtgagcctccacttcctcctctgtgaaattgagagcacttacctggcaggctgtcatgggcatcaagtaacagggcactccacctggaccctgacacgtgatgcacaggaatgccagctgctatgccatgggtgtggcagtagtaataaagtgaccatctgtatcctcaccacagtgaagcctgtccagggctttctctcctatgcccccatgcctccaggtggccttggatcctgttggttctgtgctctgctcagcgacctttctcccgtgggagttcctgggggttcagcttcatcctacagacagcagcacacactggctgtgcacccttttttttttttttttttttttttttgagatggagtctcgcttttttcgcgcaggctgaagtgcagtggtgtgatcttggctcactgcaacctctacctcctgggttcaagtgattttcctgcctcaccctcccaagtagctgggattacaggctcccaccaccacgcccggctaatttttgtattttcagtagagatggtgtttcaccatgttggccaggatggtcttgaactcctgacctcaggtgatccgcccacctcagcctcccaaagtgcagggattacaggcgtgagccaccacacccggagtgccggttgtttttagcagtttgtcttgttcctggagagactggctcctgcccaggagctcggggagtagggccgcggggtgctgcctcacacctcgagtttggccgtaagcagaggggacattttgtgactgtccccctcctgagcttcccagcagcttttctccaagttacagcccaaaagctcaggtggatttgcaacccaacggtgtctgtgcacctcccactgatgcccgaactgccctggccaagaaacggggccgtcagaacgctgcactaactgcagccttgggcctccatgccagaggccatgcccttccatccaccaccccctggcctgggccctggccctcctggctcgggaactccaggccccttcctcacggatcgagagacgtgtatttaccgcacaggtgcttgtcattctcttgtggcctcttctccagggagatcacagaaggacagggcctcactgaggtctcggacatggaccctttgatagtggcaggagccaggctgggcaagaggcggccacagtcacctcagcagtgccatcaccaccgccattcagcccttccctgagccgggcgcgcccctggctctggccccagtgtcccagttacagctcacaggagcttgtggtgcccagcggctgcttctgattgagagtcgaggtcggaggctttgggaggctgagaggctgctcggtttcacaactgctgagggagacttgggctccatctcaggtctgccccatgtcgccctcaacctccagccaccggtcctccgtgtcccccatggccaggcacggcttgcagacatctgtcgttggctcctctcagccgtcgtgggctgaccctggcacgtcctcctgtggctgagcccagtggggacagctgcttccttttattaccctagaactctcgtctttgatcaggccccctcccctatgccacacagtccctgtcactcgggtgagcccagtagtcatggggaaggcctgcgggttccaaacatccaaaggcttgcgtgcagcatgacagcttgaaaccgatgttttttaccttgatcagatttcagcttggcgggggctttgctcagctttcagtgaggcctgggccgatttcccagcatcccctcctgaggccagcctctgtttcctgtgattttctgcacaaagtgggagggaggagtcttaggaaatggggggccacctcgaaacctaggcctcctctggcttctctgtgccagtgcccccacgctttgtgtctgtgtccccagcccatgggactgtgttattccctgagtgctgccgcatgcccagcccgcactgaggacgtggagccccgaggggcaggatggcctccatggtcacacgtaggaagtggcctccaccctccgatgatcctctccccccctccctttcagcgccttccccgggggtgtcatcagccctcctgcctgtgctttgtcccgtcttctgcaggcgcatgggacgtgctgacaggtcctctgccgggttcctgccttgctatgcgcacgctggtcaccacagaggcctggcccttcttctgtagcagtcccacacccgcaacaggtgtggctgctgaccacctgctttctgcccctctggtcctgaggagggcgcagtgggcactcaggcgtggctgagcagatgtgtgttgccgggaggaggaaggactgctccagtcagggctgaatttcccacccggagcatttctgctgtatttggtgtagcgcctgctgcttaaagctctgattcccagttggcaccctttcccttctgcattgaaaaacatacggatgcatgtcttcttgcagtgaatgtgtattctcccagcctctcttctgggttggggctggaggtggagcggcacacaggagccgcagcgatggaggatgtgcgggtgcagcaccccgtacagcagggatgccaaacccgcgctgagtccctctcaacttctgctttgaagcccagtcacgccattgcctgggttttgctgggcggggctgcatgtgatgttctcctctgtccctcccccagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggtggactgtgacggtgaggccctccccgtcaaggctctgccaagaccctggccctgccctccgggatacgagcttggggctgcctccggcctcacaggagtaggggctctgaaaacctttgcttgcagggagattgccaagtctgtcttttaggcccaacaaggaaaactctgcagttccacccatcctgtcccaccaggtagtgtggcttgaaggcagactgtgagggtctatctcaccttcctgcattaggtcaggagtttcacagaaacctgaggcacattcaggggtgggctgcagaggtccatggctcacaccctggaaaatccgcccccaaaagacagtgctgtctccactgaccagtctgtgggatagtgcttaagcctgagtggtttctatcaacatgtagaatcaggaggtataaagagatttgctcaggcatcctgggccctctctgaccagcaggatcttcctttagatcttgacagtgaaacacatctcttctgtgccccctgtgagttttctttcattcattcattcattcattcattcattcattcattcgagacagagtcttgctctgtcacccaggctggagtgccctggtgtaatctcggctcactgcaacctctgcctccagggttcaatcgattctcctgcctcagcctcccgagtagctgggatgacaggtgcgcaccaccatgcctggctaatttttgtatttttagtagagacagggtttcaccatgttggccaggctggtctcgaactcctgacctcaggtgatccgcccgcctcagcctcccaaagtgctgggattacaggcatgagccaccgcgcccggcctgagttttccttttatgaaggacctgcttggttggttgcctgccacatgttgtcagcaccatgggcccaggactgctgaggagctgttgatgccctcgctctcccagagccaccggctctgttagataattcacatgcagtctggccactgtcctacgtcctcattcacaaagagcagacatttcgtagaagatgagggcctgggagtaacctccctgcatgtttttctataaaggcatagtggttaagtccttccagctcattgaccattggagaattttatggaggctgtagactaggggctggtaaactaagggcccaggggccaaatccagcctgccacctacttttgtaaataaagttttcttggtgcacagccatgcccattcattcatttgcacaatgtctgtggctgctttcatgccaaaagcaggagaactgagtggttatgctggagacctacggccttcaaagccccagacctcacgtctggcccttgacagacagagcttccccagccctgctgcgcatcctggcccagcatgtgctgtgtgtgtgatttcagcttgcaggagccgtggttaggaattgtccctgtgttggtccattttgcattgctatgaaggagcacctgaggccgggtagattatgaaggaaagaggtctgtctggctcatggttctgtaggcagcaccagtatggcacccgcatctgctcagcttctagtgaggtctcaggaagctttgactcatggtggaagtcgaagcgggagcaggtgcatcacatggtgagagagggagcaacggagagagagagagagagagagagagcgcctctccctcttgccctcaccttgagaggagatgccaggctcctttaagtaaccagctcccatgtgaactcacagtgagagcccatttgctactgcggagagggcaccaggcatctgctcccatgacccaaacactgcccaccaggccctacctccaaccttggggtcatattttattctgttctatgctatgctatgctatgccatgccatgccatgccatgctattcctattctattatttgagacagaatctcgctctgttgcccaggctggagtgcagtggcatgatcttggctcactgcaacctccacctcccaggttcaagcgattctcctgcctcagcctcccgagtagctgggattacaggcacacaccaccacacccgggtaatttttgtattttcaatagagatggggtttcaccatgttggccaggctggtctcaaactcctggcctcaagtgatccacttacctcggcctcccaaagtgccatgattacagatgtgagtcactgcgcccagtgagggtcacatttccgttgagatttggaggggcagacgttggagccatctgagccccctcgtcccgctctagcttctcctcccgtgtgccccgcggtgctggtggcaggcccttacgccggttctggctgcacgctctgttccagaagctttcttccctgcttggttaccagaaaatcatcccatccattacaaggacagggtccccttatctcccattcccagggcaggacaccgggggcagggcaggtggggaactgagcaagttctctgggggcaggcgtggctatggctccctctgggtgggcgtctggggaggggtggaggcagccgtcagcgccctggcttgctcttcctccctggccagagactgtggccttgtgctgctcccgtgtgggctgcctgcacctccagtgggttgtgctccctcccctcccctcccctcaagctctgctgagcaccactgccttccacagcccccactctcgggaggcgaggctcctcgtggccattcctgtccttggcacccacccccccaccaacctggtagagccttgggcggggtctgttactccttgcatggcgtagacctccccacagtaggcacctgacacatacctcctggggggcaggcaggaggtgcgttgaggtctcagccctggcagtccctcccctgcgtggcataggcctcgccacagggtcatcgagggtgggtggagactgtactagaccactccccgctggtcctagaaagggtcccatctgtctgctctctgtttggagtccagaccttggttgctgtgccctgcatggtgggctggggggcaccctccagcctctctgagtgcatggcctctccttgcagccatctgcctgcccaaccagttccggtgtgcgagcggccagtgtgtcctcatcaaacagcagtgcgactccttccccgactgtatcgacggctccgacgagctcatgtgtggtgagccagcttctggcacggggaaggggcgtccgggctgggttcccccaggaacgtggagtttaggggaggagacgtgcctttccagcggggctgggggctgtgtgggagactcaggcggctgggaggctccttgcgggaggcagggaagcctttcccagggcagcggccaggaggacagactgtgagctgtgggctcggcggctacagagtctgcctcagtgggcggggctgatggtgtccaggtgcctgcagcacgcacccacccacgggaccttgctgagcagcgtctgtcaggcagcaagattacccgagggctgcagtggtcctgttccctggcagcttactgtctggctgaggaggagtgatgttcacatatgcacacatgtcatgtgcacacacatgtacatgacaacatcccacatgctcctcaaatagcatgacctgtacagtcacggatatagggcctaggggataggaggccaagacagtcagggaagactttccagaggcagtggctcctgaaaggctgtctgattcaggcaggaagggagctgagttcagataggaagtagcaatgagtcattgtgtctggggacatggccactccttcgctgcagagggacctgggctgagagctcctctcttatggctgcagtcgggagagaagtctgttggggggagaagggggcttcctcaagggactccctgtgccctttggcaccttcgtgccaggtcaggcttgaggcctgaaggcagtggtgggggccaccaagggtcgcctcctctgctgggcaagttcccagtctgacgggcctgtgccgtgggccccagctgtgggggcgctgttgatgcgcagccaggcctcgccgccagagcccgcacgcttccattccgctgacttcatcgacgccctcaggatcgctgggccggccctgtgggagagtgaatgtggcttttgccaaagttgagtctggagcctggaaacttccctatgggcagccttgatagtggagtggcccaaggagcccacccagccgaccctgcccctcccgtggctggtgggcggcaccaggggctgcctggctttgctcgttcaccaacatcacccgggctggccagggcgcgctcacttctgccaccaccgagggccctgggcgaaggagtgaataccaggctgccttggcagggatgtgttgagggctgtggggagtcggacagcggcgggggtcagaggaggaggagggtgcaccgtgcaggctgaagggccacgttaccctgaggttggccaggctccccaggcctagcctcccagctcccccactttctccccaccctccaccagtggcaaagccagccccttcagggcgcacggtgtctgcccccaaggagggcccattccgttggggttaatgttggccacctctttctgtttgtctctggcagaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggtaaggagcctgagatatggaatgatctggaggaggcaggagagtagtctgggcagctttggggagtggagcagggatgtgctaccccaggccctcttgcacatgtggcagacattgctaatcgatcacagcattcagcctttcccactgagcctgtgcttggcatcagaatccttcaacacagaggcctgcatggctgtagcaacccaccctttggcactgtaggtgtggagaaagctccttggacttgaccttcatattctagtaggacatgtgctgtgttgtccacaaatcctcatgtaccctagaaatgaatgtgggggcggctgggctctctccagagctgaaggaatcactctgtaccatacagcagctttgtcttgagtgcagctgggatttgtggctgagcagttacaattcctacgtggcccaggcaccaggaacgcaggctgtgtttgtagatggctgggcagccgcaccgcagagctgcaccatgctggtttgtatcacatgggtgaccatggtatgtctaagaaggtggagtccctgtgaggtctgcaggtgcccccacagctccaggccaccttgaggattgcctctgcctgcccagccctgagttccctctcccctgtcctgtcccactgtcaccccaagccggcctcattgggagcctgttggatggcagggtatagatgtaacctgattctctctggggagcggggttatctggcttctcaagagctcctaggagcccacagtggtggcaccatcacagtcgcagcagcccccagagaacgcggccctgtctgttcctggcgtgctctgtgctgccccgcctgggttccctgccccagtcgcaggccccttggaggaggtaccatgtgtctcccgtttcacagatgagccccggggagctcactctagtagtggccagagaggcctgcggctcagggagcggggcacatttccaacaggacacaccgccctggtctgagtctcgtgggtagtgggagcagaggagagcgccctatgtctgtggggcggcttggctgagcctggaagccacctgacctcccccgtcccttccctgccaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccggtgaggggcggggccggggaggggcggggcgggatggggctgtgggcccctcccaccgtcagtgctggccaccggaggcttcccgggttcctgggggctgtgccaccgcctctgaggcatgcttgctttcttcccttttcaaacccttctgcttccttctttaatgacattgttgattgtggataatctgaaaactacacaaaaatataaagagccaaaatctcacccaaatccacctcctagagtggctgttgggctccgtcagcatccaggcggccgtctgtgttccgcacggcccagcccatcgatagccgcctgcaccaggcctgtctgccctctgtgagcctccccacagggttccctccacaaacaccctgttctcccacccagggctggctgcttcctggaaaacagctggatggttttgtgcatgacagacaaacacagggtgattttcgtggctaaaatactccctggagcttttggcagggtgaggggctggctccagctgagccacgccttgagtgaaatgactgtgaggagaataaactgccgctgccctccaggatcactggggctggctggggagaacccccgtttctgggagcacagtcccaggatgccaaggcgagcttggtgccgagatgtgaactcctgagtgtaaacagcgggggctgacttgacatgctttgtatgcttttcatttgttcctgcagctgtatgcccctaaggtgagtccagcccccttctgcttcctctggggcctcgccagtgagccccaccttgctggggctggttcctcctgcccttctgggtatccctcacatctggggtcttgtcttcttgttttatttttcttttttttttgagacggagtttcacttttgttgcccaggcttcagtgcaatggtgtgatctctaggctcaccgcaacctctgcctcccaggttcaagcagttctcctgcctcagcctccctagtagctgggattacaggcatgtgccaccacgcccagctaattttgtatttttagtagagatggggtttctccatgttggtcaggctgatcttgaactccctacctcaggtgatccgcccaccttggcctcccaaagtgctgggattacaggcgtgagccaccgcacctggcctttttcttttcttttcttttcttttttctgagacagggtctcgctctgtcacccaggctggagtgcaatggtgtcatcatggctaactgcagcctctaccttctaggctcaagcaatcctcccatctcagcccctaagtagctaggactgcacgcatgcatccccatgcccagctaatatttacattttttgtagagatgaagtttcactatattgcccaggctggtctccaactcctggactcgagcgatcctcctgcctcggcctccccaggtgctgggattacaggcgtgagccaccgtgcctggcctggggtattgtcttcttatggcacctgactgtggtgggccctgggaaggaagtagcagaagagggttcttcttggtttcctggacagtaactgagtgttctggaggccccagggcctggctttgtttagggacaaagggaactggtaaccagaagccgagagtttaaacacccactgcccttcttccctgctcctgctgctgcaacccagcttaaccagccaggagtgctaggaacccaagcagggcccccgagcacacagcaggcagctcacgaattctcttttcctgttctcccttgggagctgggaggatcttaatcaggcaataagagatggcactgagcagccagctaattttttaaatcactttattgtttaaccatatgactcacccacttaaaaaagggtacagttcagtgggttttagtgtattcacagatgtgtgcaaccctcaccacagttaattttagaacattttcctgcccctaaaagaaactctgcatgaagccagctgtttttaaattagcaaagttattttgcatcctttaaatatatgttcatggtacaaaattcaaaagatacagaagagtctgcagtccaaagagactccgcccccatgacgccaagcaggactccctgggaggcatggcctcctgcagtgtgtttcttctatgtccccccaggggtcatctgtacatatgcaagcatacaagagcgtggactttgttttccaagccagaagataattgtagatttatgtgcagttgtgagaaagagcacagacccatttatcctctgcctggtttcccccagtgctgcctgccatcttgcatgacttccattcctatcataagcaagacactgataacgattctttcaccttattcagattgacataagtgttttttgtttgttcttgagacaaacttcctctgtcacccagtgggagtgcagtggcacaatcacagctcactgcagcctcaaactcctgggctcaagcgattctcctgcctcagtcccctcaagtagctcagatggcaggtgtgcaccatcatgccaggctaatttttaaattttttgtggaggtgaggcctcactaaatttcctgggctagtcttgaactcctgagctaaagtgatcctcctgcctcagcctcccaaagtggtaggattacaggcatgagccactgcgcctgggctgacatatgtgttttcgtaagcccgaaagatagcatctgaagagtcaacattgagccttgccttttgctgctaatgatgtataaaagctgctgttctgagcatttcggaggctcccagctgccgtgtgcaccctgcctagagctctaccgtaacccatctccgggaggaggtgctattgttttcctcattttgcaacaaggaggctgaagaactgagcatgaaccactggcctgggtcgttcggttggtaggcagtggggccaggccatccaactcacaaccaccttctactctgcttcccccgcaccctgaagtttgttctgttttgaggacacagccgtcacattcttggtggctgaacagcactccttgtcaggtgtggctgggcccccactggagggcatcatggtcctctctcctgctgcggttgaaccttggctgtttcaaccactcctgccaagtggccctctgaaagggacagtccatcttttctcagcagagggccacactggcaaaacggtccctggcaccctttctctccacctgtctaatatagagtaaaaatggtatcatgttaagatcttcatttatatttattttatcatgaatgatgtaagcatcattttgtgtgtttaagaacctttgggcccagcgtgatggcttgcagctgtaatctcagcactttaggaggctgagatgagcggatcacttgaggccgggagtttgagaccagcctggccaacatggagaaaccccgtctctagtaaaaatttaaaaattagccgggtatggtgatcccagctacttgggagtctgaagcatgagaattgcttgaacatgggaggcggaggttgcagtgagccgagatcgcgccattgcactccagcctgggcgacagagcgagactctgtctcacaaaaaaaaaaaaaaaagaaaagaaaagaaattatcaatctcctcttttatggcatatatatatatatatatatatatatatatttatttccctttcttggttatgttcataaaggcctcccctgctctgatcataaaaaacaacttattttcacactctctctcttttttttttgagacagagttttgctcctgttgcccaggctggagtgcagtggcgcaatctcagctcactgtaacctccgcctcccgggttggagtgattctcctgccttaccttcccgagtagctgggattataggcatgcaccaccatgcctggctaattttgtacttttagtagagacgggggtttctccatgttggtcaggctggtctcgaactcgcgacctcaggtgatccacccacctcggcctcccaaagtgctgggattacagacgtgagccaccatgcccagcccacactctctttcttaacgtcctcctcctttcgttttacgttcacatctttaattcttctgggatgtaattagatttgatgagcaaggtgggcatccagcttgtttcttggctgatggcttatgggtggcgtgaattagtcggggtctatcaggaggcagaaactctatgagaatttgaacagagaaagttccgtctacaggcttattaccagggactggaatagcagaaattgaacagtgagatgtacagagaactctaagaatgcaggaataggccaggcatggtggctcacacctgtcatcccagcactttgggagaccaaggcgggtggatcacctgaggtcaggagttcgagaccagcctggccaacatagtgaaaccccatctctactaaaaatacaaaaaaattagctgggtgtggtggcgcatgcctgtaatcccagcttctcgggagtctgaggctggagaatcacttgaacctgggaggcagaggttgtagtgagccgagatcatgccattgtactccagcctgggcaacaagagcgagactcagtcaaaacaacaacaacgcaggaatagcagatgagccgaggtggggcctccccagcccccaccccccaccccgcaccctgggccgagatccagtcctctttgaatagggcctgggcgtggttcacgggacatctgagacattgccgaggcgctgcactggtggatcttgccagaagtctgcccagtgcagatttgggcagaatctcaaactgccttgggatgtaggagagaaaccaggcctggtcaagttcatgggaagaggtggaaacagaccccataggctggggcttgggcagctgtaggaagccctctctgctgcctccctgcctgctctctgctttgaagcatcttccccagtgcccccagtctcatgccctctcaacgttggggtcaaatcctgaggaatacccagactggctctctgggccaaagaggaccctctccagaaagagcagggcccagtgcggcttcctaaagggcaggggaagggcctggccactccccagaggctactcaccagccatcaggatagccccaggaagcaggccttctcgagcccattttattactttattttattattttatttaattttaaatttattttttgagacagagtctcactctgttgcccaggctggagtgcagtggtgcgatctcaacccactgcagcctctgcctccagggttcaagggattctcccacctcagcctcccaagtagctgggattacaggtgcccgccaccacacccggctaattttcatatttttagtagagacgaggtttcaccatgttggccaggctggtctcgaactcctgacctcaagtgatccgcccgcctcggcctcccaaagtgctaggtcaagcccattttaaagttgaagaaactgaggctgaggtaaattccctccccagggatcctgctgcagccagaaggtggtaaaacaggacttcacccgggtctgtctggcgtgaaaggcagtgttcttgtaccaccctagggggcctgagagaactgagtccctcgggcataactgacagttctgttcccattattccgcaggggctcggatctggctgtatgctttccaggatggccttggagacccacataagccctacaccctttgggaagctgcatgttgggttggggtgccgtcagtggcacttgtggaaggtgcagacctgtgtgggtgtgtgggcccagggcccctggtcccttcctccctttgtagggctggttgtgtgctgcctggacctggggggcacgttcacgtggtgaatttgtctatttactatccccgctttggggctggtgccagcacaggcccttgtgaagggggtgcctttgtctggagtgggactgtggcccctccctcagcgtggtgacttctgtgtcagggcttcagcagggacgcagagcccctgagtgttcggaacaagggcgtcattgcaggagttagactgtgtgtgatggagggaggaggggcaggaggaaaggtcagaaggagagttcctgggaaggtccctgaggagcctggtgaggtgctaactggtgtggaggacactcagggcctgtggggacatctcctactgctgggggccagccacaaagggaactggccgaagtcctgtccccgccttcacagcccagcatctggtcacaaggcaggtacttggaagggcgcgggcacctgggccaaaagtgcctgggttccctttgcctttcactgagatgaccttcggggcaggtggctgctgcctcccctcctgtccccaggttttgccaactggccagaggaaggggtcctgggaagcaggggggccagaagccctctctgcaaggaaagcccgaggggtgtgggaggaaggaaggaatgcccaggctggcgaggctctaagtcaccctggcttggctctcctcagatcctgaacccgccgccctccccggccacggacccctccctgtacaacatggacatgttctactcttcaaacattccggccactgcgagaccgtacaggtaggacatcccctgcagccctccatggccattgggttcccgccagcccgtggtggaggggcctaatccccatgccactgatgaggggaggtattctgggtgctagtgggcaggtgccgggcccagccctgcctccctctgctctgccaaccacactaggctgcctccccagacaagctcagcgggcactgcatgttgggttcagaaatcagcagaactccacgttctgagctgctcttcaagttgctcctatgggggttacttttaagctgggaaatggctgtggcgtcgaggggccgggggcttgggctccaaactctgactgtgtgtttgagtccggctgtggaaacctagccattgagatgccccctcttggtggctctgtcctcttaggatgggacaagtctgtgaaggctgctgcagcacccaccgtagacccctaatcgtgtgacgtcaccaggatggtccgggctgctcacttgccacagtggcctgtttgagcccgggaagccaacggggctgctcagctggacaccagccccccgagctgcccatgttggggtcacaggccccacctccctggttggggaggggcaactgagagtgtggagaggtgggacccaggtgtgctggtctccgcaggggctggatcagagcctgggatgggcagggtgagcctcctgacctttaacccagtggtgtcaggcaacgtggcccacccgccagccgcaccaggccccacccccgcaggtgaaggggtgggataggctgggcctgggccaggacacctctggaccacgcattcctcattgcttgggtccctggagcagcagggcctcccgagtgtggtgccgcctgccacctagtggccatttccacgaactcccaggcctggctggggagccggaactgcagcctccatttccaccccactccgggtcgggccacctccctgatgcctcagtattatatcaaactgtcacagtctgtcccacagccttacagaccactgtctccagaatggtcacatccacactgggcagcccagtctcgctagttcctcgtcccacctcctgcctttgctcatgcccgtcctgctctgggcccaccgcggacacatcttccccccgcccgccgtctgacctcacagcagctgggccccaagaggagtatcctgtcctgctgcacttttctcaacacccggtgttggctgcaccttcccacccattgcaggcccctctgtgacaggacgggggctcctaaacacaccacagttccgagtctgaactcacacagtgggatgcggcgtttctgggccacagttgggtgcaggtagcctctgggaggatgggaggtcaggagccatcttgcgagtcaggttgcttgaactcaggatggaagtgttccgggcccattggttgctgtattagcctgttctcacgctgctaataaagacatacccaagactgggtaattgtaaaggaaagaggtttaacggactcacagttccacctgcctggggtggcctcacaatcatggtagaagacaaggaggagcaagtcacatcttacatggcttcagggaacagacagcatgagaaccaagcgaaaggggtttccccttgtaaaaccatcaagtctagtgagatttattcactaccacgagaacagtatggggggaaccacccccatgattcaatcatctcccactgggtccctcccacagcacgtgggaattatgggagtacaattcaagatgagatttgggtggggacacagccaaaccctatcggttgccaacatttacagtaacagtgttaggtgaacagttgtccagtctcctgttttgtcggacactgtttctagcaccttccaggcagaatctcatgtatccttcactttcgaaatgggtactatttcatccccacttttatcaatgagaaactaaagctcgaagaggtcaagtaagttcctggccaaggtcagctagcaggctctagaggcctcgttctccttagaggcagccttgccagggcccaggcttggcaggctgcagggcaggtgcgggcatgcccatggtagaggtgggaccattgaggctcagagagggtaagtgatgagccctggcgacacagcggggtgggtccagagtccggcctgcatcttctggagctggccagtggacaggcctttcccgttcacagccccggggctgctgtgcccaccagggcggatgtgcctaccgaatcccactcctctgtgtgtgtccctttcaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaactgccattcttttgtgccctgtgtgcatttgagttgtgtgtccccgtggagggaatgccgacccccggaccaccatgagagtcctcctgcacccgggcgtccctctgtccggctcctgcagggaagggctggggccttgggcagaggtggatatctcccctgggatgcatccctgagctgcaggccgggccggctttatgtgcgtgtggcctgtgccgtcagaaagggccctgggcttcatcacgctgttgctgttcgtcttcctcagattcttagtcttttttttttttttttttttttgagacggagtctttctctgtcatccaggctggagtgcagtggtacaatctcagctcactgcaagctccgactcccaggttcaagtgagtctcctgcctcagcctcccgagtagctgggactacaggtgcgcgccaccacacccgcccagctaatttttgtatttttagtagagatggggtttcaccatgttggccaggatgatctcgatctcttgacctcgtgatccgcccacctcggcctcccaaagtgctgggattataggcatgagccactgtacccagctgactcttagtcacttttaagaaggggactgtgccttcatttttcactgggccctgcagaatatatgcctgggctctgggctcttctgaacctgtgttggcttccatctgacctctctgtgccagcccaaggctgctgctcttcctgagggcaaggagccccatgactgcgtgttgactcgctggatggggctgctgagcccactctgccacaccacgtgcccctggcagggagggaatccctgggtcctcacaggaacagtcagcaagccacacctgacgcctgctgtgggcccatccctgcggtgctggagaagacagacaaggcctggtcactgcctctgcagggtccccagtccgtggaaggagacagtaatctaggcattttcggtggggaagctgagctgttctcgtgtcctgaaggccaggcgggaacagccgtcttcagagggaagggagaaaatgcacatcgcatcagtggagaagggcctgacttccctcagcatggtggagggaggtcagaaaacagtcaagcttgagtattctatagtgtcacctaaata

SEQ ID NO: 10 - DNA, 8705 bp, Homo sapiens
ggactcaggggcagcagggaggtacacccatggttagtgggcggaccatagggggtaatgagagggtgaatcgatggaacctgggggacacaatcgaagtggttccagagtcgggctgtactaattaaagagacggggcagtggacaggcattttcagttgactgcccagggagtgttctgcccaacagggaggatatgcgtacagaatcatactcgatcagcatgagtccaattcagaccgtacatcagtggagatatgggtcccccgatgactccgtggaacactgatgtttgtgacaggggagtacagcaccagccatcagcaggccagtaaatcataccggcctgcgaaattggactcagacccggatccaccctgaccgacgtcccaagcccccaccccccaccccccaccatgggccgagatccagtcctctttgaatagggcctggccgtggttcacgggacatctgagacattgccgaggcgctgcattggtggatcttgccagaagtttgcccagtgcagatttgggcagaatctcaaactgccttgggatgtaggagagaaaccaggcctggtcaagttcatgggaagaggtggaaacagaccccataggctggggcttgggcagctgtaggaagccctctctgctgcctccctgcctgctctctgctttgaagcatcttccccagtgcccccagtctcatgccctctcaacgttggggtcaaatcctgaggaatacccagactggctctctgggccaaagaggaccctctccagaaagagcagggcccagtgcggcttcctaaagggcaggggaagggcctggccactccccagaggctactcaccagccatcaggatagccccaggaagcaggccttctcgagcccattttattactttattttattattttatttaattttaaatttattttttgagacagagtctcactctgttgcccaggctggagtgcagtggtgcgatctcaacccactgcagcctctgcctccagggttcaagggattctcccacctcagcctcccaagtagctgggattacaggtgcccgccaccacacccggctaattttcatatttttagtagagatgaggtttcaccatgttggccaggctggtctcgaactcctgacctcaagtgatccgcccgcctcggcctcccaaagtgctaggtcaagcccattttaaagttgaagaaactgaggctgaggtaaattccctccccagggatcctgctgcagccagaaggtggtaaaacaggacttcacccgggtctgtctggcgtgaaaggcagtgttcttgtaccaccctagggggcctgagagaactgagtccctcgggcataactgacagttctgttcccattattccgcaggggctcggatctggctgtatgctttccaggatggccttggagacccacataagccctacaccctttgggaagctgcatgttgggttggggtgccgtcagtggcacttgtggaaggtgcagacctgtgtgggtgtgtgggcccagggcccctggtcccttcctccctttgtagggctggttgtgtgctgcctggacctggggggcacgttcacgtggtgaatttgtctatttactatccccgctttggggctggtgccagcacaggcccttgtgaagggggtgcctttgtctggagtgggactgtggcccctccctcagcgtggtgacttctgtgtcagggcttcagcagggacgcagagcccctgagtgttcggaacaagggcgtcattgcaggagttagactgtgtgtgatggagggaggaggggcaggaggaaaggtcagaaggagagttcctgggaaggtccctgaggagcctggtgaggtgctaactggtgtggaggacactcagggcctgtggggacatctcctactgctgggggccagccacaaagggaactggccgaagtcctgtccccgccttcacagcccagcatctggtcacaaggcaggtacttggaagggcgcgggcacctgggccaaaagtgcctgggttccctttgcctttcactgagatgaccttcggggcaggtggctgctgcctcccctcctgtccccaggttttgccaactggccagaggaaggggtcctgggaagcaggggggccagaagccctctctgcaaggaaagcccgaggggtgtgggaggaaggaaggaatgcccaggctggcgaggctctaagtcaccctggcttggctctcctcagatcctgaacccgccgccctccccggccacggacccctccctgtacaacatggacatgttctactcttcaaacattccggccactgcgagaccgtacaggtaggacatcccctgcagccctccatggccattgggttcccgccagcccgtggtggaggggcctaatccccatgccactgatgaggggaggtattctgggtgctaatgggcaggtgccgggcccagccctgcctccctctgctctgccaaccacactaggctgcctccccagacaagctcagcgggcactgcatgttgggttcagaaatcagcagaactccacgttctgagctgctcttcaagttgctcctatgggggttacttttaagctgggaaatggctgtggcgtcgaggggccgggggcttgggctccagagtctgactgtgtgtttgagtccggctgtggaaacctagccattgagatgccccctcttggtggctctgtcctcttaggatgggacaagtctgtgaaggctgctgcagcacccaccgtagacccctaatcgtgtgacgtcaccaggatggtccgggctgctcacttgccacagtggcctgtttgagcccgggaagccaacggggctgctcagctggacaccagccccccgagctgcccatgttggggtcacaggccccacctccctggttggggaggggcaactgagagtgtggagaggtgggacccaggtgtgctggtctccgcaggggctggatcagagcctgggatgggcagggtgagcctcctgacctttaacccagtggtgtcaggcaacgtggcccacccgccagccgcaccaggccccacccccgcaggtgaaggggtgggataggctgggcctgggccaggacacctctggaccacgcattcctcattgcttgggtccctggagcagcagggcctcccgagtgtggtgccgcctgccacctagtggccatttccacgaactcccaggcctggctggggagccggaactgcagcctccatttccaccccactccgggtcgggccacctccctgatgcctcagtattatatcaaactgtcacagtctgtcccacagccttacagaccactgtctccagaatggtcacatccacactgggcagcccagtctcgctagttcctcgtcccacctcctgcctttgctcatgcccgtcctgctctgggcccaccgcggacacatcttccccccgcccgccgtctgacctcacagcagctgggccccaagaggagtatcctgtcctgctgcacttttctcaacacccggtgttggctgcaccttcccacccattgcaggcccctctgtgacaggacgggggctcctaaacacaccacagttccgagtctgaactcacacagtgggatgcggcgtttctgggccacagttgggtgcaggtagcctctgggaggatgggaggtcaggagccatcttgcgagtcaggttgcttgaactcaggatggaagtgttccgggcccattggttgctgtattagcctgttctcacgctgctaataaagacatacccaagactgggtaattgtaaaggaaagaggtttaacggactcacagttccacctgcctggggtggcctcacaatcatggtagaagacaaggaggagcaagtcacatcttacatggcttcagggaacagacagcatgagaaccaagcgaaaggggtttccccttgtaaaaccatcaagtctagtgagatttattcactaccacgagaacagtatggggggaaccacccccatgattcaatcatctcccactgggtccctcccacagcacgtgggaattatgggagtacaattcaagatgagatttgggtggggacacagccaaaccctatcggttgccaacatttacagtaacagtgttaggtgaacagttgtccagtctcctgttttgtcggacactgtttctagcaccttccaggcagaatctcatgtatccttcactttcgaaatgggtactatttcatccccacttttatcaatgagaaactaaagctcgaagaggtcaagtaagttcctggccaaggtcagctagcaggctctagaggcctcgttctccttagaggcagccttgccagggcccaggcttggcaggctgcagggcaggtgcgggcatgcccatggtagaggtgggaccattgaggctcagagagggtaagtgatgagccctggcgacacagcggggtgggtccagagtccggcctgcatcttctggagctggccagtggacaggcctttcccgttcacagccccggggctgctgtgcccaccagggcggatgtgcctaccgaatcccactcctctgtgtgtgtccctttcaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaactgccattctttcgtgccctgtgtgcatttgagttgtgtgtccccgtggagggaatgccgacccccggaccaccatgagagtcctcctgcacccgggcgtccctctgtccggctcctgcagggaagggctggggccttgggcagaggtggatatctcccctgggatgcatccctgagctgcaggccgggccggctttatgtgcgtgtggcctgtgccgtcagaaagggccctgggcttcatcacgctgttgctgttcgtcttcctcagattcttagtctttttttttttttttttttttttgagacggagtctttctctgtcatccaggctggagtgcagtggtacaatctcagctcactgcaagctccgactcccaggttcaagtgagtctcctgcctcagcctcccgagtagctgggactacaggtgcgcgccaccacacccgcccagctaatttttgtatttttagtagagatggggtttcaccatgttggccaggatgatctcgatctcttgacctcgtgatccgcccacctcggcctcccaaagtgctgggattataggcatgagccactgtacccagctgactcttagtcacttttaagaaggggactgtgccttcatttttcactgggccctgcagaatatatgcctgggctctgggctcttctgaacctgtgttggcttccatctgacctctctgtgccagcccaaggctgctgctcttcctgagggcaaggagccccatgactgcgtgttgactcgctggatggggctgctgagcccactctgccacaccacgtgcccctggcagggagggaatccctgggtcctcacaggaacagtcagcaagccacacctgacgcctgctgtgggcccatccctgcggtgctggagaagacagacaaggcctggtcactgcctctgcagggtccccagtccgtggaaggagacagtaatctaggcattttcggtggggaagctgagctgttctcgtgtcctgaaggccaggcgggaacagccgtcttcagagggaagggagaaaatgcacatcgcatcagtggagaagggcctgacttccctcagcatggtggagggaggtcagaaaacagtcaagcttgttgctgggtgacagtgcatttaataatcaaaatataggctgggtacggtggctcatgcctgtaatcccagcactttgggaggctgaggcaggtggatcacttgaggccaggagtttgagaccggcctggccaacatggcaaaacctcaactactaaaatacaaaaactagccgggcgtggtggtgcacgcctgtaatcccagctacttgggaggctgaggcaggagaattgcttgaacctgggaggcggaggctgcagtgagccgagattgtgccactgcactccagcctgggcaacagagcaagactctgtctcaaaaaaaaaaaaaaaaaaagcaatacaaaatacaaatatcactttcactaaaagaagggatggaagacccaaaacaaacagaaaacaacaaaatggcaggagtaagtccccacttatcaataataacattgactgtaaataggctaagctctgcaatcaaaagagtgggccaggagcggtggctcacgcctgtaattccaacgctttgggaggctgaggcggatggatcatttgatgtcacgagttttaagaccagcctggccaacaaggtgaaaccccatctgtactaaaaatacaaaaattagccaggcggtagtggcacgcacctgtaatcccagctacttgtgaggctgaggcaggagaatcactggaggctgggaagcggaggttgctgtgagccaagatggagccactgcactcccacctgggcgacagagtgagatcctgtcttaagaaaaaaaagagtggatgaatggatcaaaaaacaagacccaaccatctcttgcatacaagaaacacactttacctataaaaacacactaggccaggtgtggtggctcacacctgtaatcccagccctttgggaggcctgactggcagatcacctgaggccaggagtttcagaccagcttgaccgacatggcaaaaccccatctctcctaaaaatacaaaaaaacaaaaaaaagaaaaaggctggaagtagtgatgtgtgcctgtagccccagctacttgggaggctgaggcaggagaattgcttgaatccgggaagtggaggttgcagtgagccaggatggtgccactgcactccagcctgggtgacagagcgagaccctgtcataaaaaaaaaaagaaaagaaaagaaaaacgagaaaaacaaacacaaaattagtagaagaaaagaaataataaagatcagaacaggccaggctcatgggcacagtggctcaactcctacctgctcaggagtttgagaccagtctggccaacatggcaaaaccccatctctcctaaaaatatgaaaaaaaaaaaataggctggatgtggtgatgtgtgtgtgcctgtagccccagctacttgggaggctgaggtgggagaatcacttgagcccaggaagtggaggctgcagcgagtcatgaatgcaccctgcactctagctgggtaactggagtgagattctgtctcaaaaaagcaaagaccagagcagaaataaatgaaatggaaatgaaggaaacaatgcaaaatgatacaaaaagttttttcgaaaagataaacaaaatcaacaaacctttagccagattaagaaaaaaagagagaagacccaaataaataaaatccgagattaaaaaggagacattaccactgataccacagaaattcaaaggatcattagaggcaactatgtgcaactatatgctaatgaactggaaaacctagaagaactgggtaaatttctagacacatacaacctatcaagattgaaccatgaagaaatccaaaacctgaacaggccgggcacggtggcttacgcctgtaatcccagcactttggaaggcctgagatcaggagttcgagaccagcctggccaacatggtgaaaccccatctctactgaaaaaatataaaaattagccgggcgtggtggcgggtgcctctaatgtcagccactcgggaggctgaggcaggaaaatcacttgaacctgggaggcataggttgcagcgagccgaggttgcaccactgcactccagccttggcgacagagccagactccatctcaaaaaaattaaaataacaaaaacctgaacagaccaataacaagtaatgcgatgaaaactgtaataaaatgtttcccaacaaagaaagcccaggaacaaatggcttcactgctgaattttaccaaacatttttttttttttgagacggagtctcgctctgtcgcccaggctggagtgcagtggtgtaacctcggttcgctggtaacttatgcctctcaggctgcaagtgattttcctgcttcaggccccccgagtggctggaaattagatggtacttgtcaaacaaggcctggctaaatttctatatttccttcaagtagaagatgtgcttccaacaaaggttgggttacggctggcttctgaaaatcttggatttcaaggctccccaaaag

SEQ ID NO: 11 - DNA, 66933 bp, Homo sapiens
tataatcaagcgcgttccgtccagtccggtgggaagattttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgttacaggccagaaagcataactggcctgaatattctctctgggcccactgttccacttgtatcgtcggtctgataatcagactgggaccacggtcccactcgtatcgtcggtctgattattagtctgggaccacggtcccactcgtatcgtcggtctgattattagtctgggaccacggtcccactcgtatcgtcggtctgataatcagactgggaccacggtcccactcgtatcgtcggtctgattattagtctgggaccatggtcccactcgtatcgtcggtctgattattagtctgggaccacggtcccactcgtatcgtcggtctgattattagtctggaaccacggtcccactcgtatcgtcggtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgttaaccgggctgcatccgatgcaagtgtgtcgctgtcgacgagctcgcgagctcggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtccgagctcatcgctaataacttcgtatagcatacattatacgaagttatattcgatgcggccgcaaggggttcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattcgagctcggtacccggggatcctctagagtcgacctgcaggcatgcaagcttctcttgtgccggttgtacgctgtcaggtcacactggtgagttaggcagggcacagatgcccagagcagagggaactttccttggggattcaacacgtgcaagtcttaggggctggcaaatcctgccctcagctagagagggggcttttatttgagaccagaatcacctgagcatcctcctgtccccagctgtgtccagcctgtctgcagggacatcctgagaggaccaggctctcccctcatccacctgcctaagtgccactctgaaccctgtccacctgtgccgtggaggggcgtgacctcaagctgctcagccagcagcaggcttggccctggggggcagcagagacccaggtggctgtggggtgggtgcttcgtggcgtggttctgaaacttcgttggaagtgtgtggacagtgccttgcctgttctctgtgggaccctatttagaaacgaggtctgagttactgggggtcatcactgtgttctgatggcccagctgtgtggaggccgcggtgcagccccatccaaggagccagggccctgggtctagccgtgaccagaatgcatgccccggaggtgtttctcatctcgcacctgtgttgcctggtgtgtcaagtggtcgtgaaactctgtgttagctcttggtgttcctgaaagtgcccccgggtctcaggcctcagaaccagggtttcccttcatctcggtggcctgggagcatctgggcagttgagcaaagagggcgattcacttgaaggatgtgtctggccctgcctaggagccccccggcacggtgctggggcctgaagctgccctcgggtggtggagaggagggagcgatgaagtggcgtcgagctgggcaggaagggtgagcccctgcaaggtgggcatgctggggacgctgagcagcatggccagcagctgggtctgcagcctggtacccggcgggacttgtggttggggctggtttgtggccaggagaggggctggcaggagacaagggggactgtgaggcagctcccacccagcagctgaagcccaatggcctggctgtgtggctctcagctgcgtgcataacctctcagtgcttcagttctctcatttgtaaaatgaggaaacaaacagtgccagcctcccagaggtgtcatgaggatgaacgagtgaccatgtagcatgggctgggtgcgtgtcacctaacatcaccagcctttgcaaggagagccctgggggcctggctgagtatttcccttgcccggcccaccccaggcctagacttgtgcctgctgcaggcccttgacccctgaccccattgcacctgtctccacaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatggggtaagacgggcgggggctggggcctggagccagggccaggccaagcacaggcgagagggagattgacctggacctgtcattctgggacactgtcttgcatcagaacccggaggagggcttgttaaaacaccggcagctgggccccacccccagagcggtgattcaggagctccagggcggggctgaagacttgggtttctaacaagcaccccagtggtccggtgctgctgctgggtccatgcgtagaaagccctggagacctggagggagccctttgttcccctggcttcagtttcctcatctgtagaatggaacggtccatctgggtgatttccaggatgacagtagtgacagtaagggcagcctctgtgacactgaccacagtacaggccaggcctctttttttctttttttttttttgagatggagtctcactctgtcgcccaggctggagtgcagtggtgtgatctcagctcactacaacctctgcctcctgggctcaagtgattctcctgcctcagcctcctgagtagctgggattacaggtgcctgccactgtgcttggctaatgtttgtatttttggtagagatggggtttcaccgtcttggccaggctggtcgcaaactcctgacctcaggtgatccacctgcctcagcctcccaaagtgctgggattacaggcatgagccaccacgcccggtcaggccaggcctcttttgaacactttgcacaccatgggtcttttcatccaggggggtaggtacagttgtacagttgaggacactgaagcccagagaggctcagggacttgcccagggtcacacagcaggatgtggcaggtgtggggctgggcctggcagcgtggctccagctttccagcatagaaatctgtgaaagcagatagtttgtcggtcggtaggggagactttctgagacccgccccagcggctcagagggtagtagccaggggccttcctgggggctcataacccagaacactgaatgggaaaaccctgatggaggaggcgcagtggagctgtgggtgccgatgggaagtcccagaggagctgggaggtcagtagcggtgctgccctctgtggagcacttagtgggcaccaggtgtgtttccaggttcatggccctgggacctgaagctcagaaggtgaagtaacttgcccagggcacccgtcgggcagcggcgggcagaggatttgtgggctgtggagcctgtgctcgtggcccagccctgggggttgtgagtgtgctggccggggagcttttcctgcaagtggactggtgtctaggagccagcatgtcaggcagcaggcagcgggagtgcagcaggcagcgggagcacagcaggcagagggcggggctcgagcagccatccgtggaccctggggcacggaggcatgtgggagagggctgctccatggcagtggctgaagggctgggttgtgccccgaggagggtggatgagggtaagaagtggggtccccaggggctttagcaagaggaggcccaggaactggttgccagctacagtgaagggaacacggccctgaggtcaggagcttggtcaagtcactgtctacatgggcctcggtgtcctcatctgtgaaaaaggaagggatggggaagctgactccaaggcccctcctagccctggtttcatgagtctgaggatcccagggacatgggcttggcagtctgacctgtgaggtcgtggggtccagggaggggcaccgagctggaagcgggaggcagaggggctggccggctgggtcagacacagctgaagcagaggctgtgacttggggcctcagaaccttcacccctgagctgccaccccaggatctgggttccctccttggggggccccagggaacaagtcacctgtcctttgcataggggagcccttcagctatgtgcagaaggttctgctctgccccttcctccctctaggtgctcagctcctccagcccactagtcagatgtgaggctgccccagaccctgggcagggtcatttctgtccactgacctttgggatgggagatgagctcttggcccctgagagtccaagggctggtgtggtgaaacccgcacagggtggaagtgggcatccctgtcccaggggagcccccagggactctggtcactgggcttgccgctggcatgctcagtcctccagcacttactgacaccagcatctactgacaccaacatttacaaacaccgacattgaccgacaccgacatttaccgacactgacatttaccaacactgtttaccaacactgacatctactgacactggcatctaccaacactgacatttaccgacactgacatttaccaacactatttaccaacactgacatctactgacattggcatctaccaacaccaacatttaccgacaccaacatttaccaacactgaaatttaccgacaccgacatttaccgacaccgtttaccaacaccgacgtttaccgacaccgacatttaccgacactgatatttaccaacactgacatctactgacgctggcatctactgacaccgatgccagcatctaccaacaccgacatttaccaacactgacatttactgacactgatatctactgacactggcatctactgacaccaacatttaccaacaccagcatctaccaacaccgacatttaccaacaccagcatttaccaacaccgatgtttaccaacgccgacgtttaccgacgccagcatctaccaacactgacatttaccgacaccgacatttaccgacactgacatttactgacactgacatctactgatactggcatctaccgacactgatatttaccaacgccagcatctactgacactgatgtttaccaacaccgacatttacgagcaccgacatttactgacaccaatatttactgacatcaacatttagccatgtgatgggggccggcttgggggcaggccttgctcttggcactggggatgctgcagagaccagacagactcatggggtcatggacttctgcttcttctccagcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgaggctcctgtggacatgtttgatccaggaggccaggcccagccaccccctgcagccagatgtacgtattggcgaggcaccgatgggtgcctgtgctctgctatttggccacatggaatgcttgagaaaatagttacaatactttctgacaaaaacgccttgagagggtagcgctatacaacgtcctgtggttacgtaagatgttatcattcggccaggtgcctgtagacacagctacttggagactgaggtgggaggatcgctggagtccaagagtttgaggccagcccgggcaaaggggacacaggaatcctctgcactgcttttgccacttactgtgagatttaaattatttcacaatacaaaattaagacaaaaagttaatcacatatccactgccctgcttaagacagaaaacatgggtgttgttgaagccagaggcagctgctggcctgagtttggtgattggttcctaagcagttgaaggcagttttgtttttccatagatgtctgttctccctttgctgggtgcagcctcgccctgctgctgtggtcgggtttcagtggcctcgtcccgtggacgcagcctcgccctgccgctgtggtcgggtttcagtggcctcgtcccgtggacgcagcctcgccctgctgctgtggtcgggtttcagtggcctcgtcccgtggacgcagcctcgccctgccgctgtggtcgggtttcagtggcctcgtcccgtggacgcagcctcgccctgccgctgtggtcgggtttcagtggcctcgtcccatgggcgtgctttggcagctttttgctcacctgtggagcctctcttgagcttttttgtttgttgtttgtttttgtttgattttgtttgattgtttgtttttgttgtcgttgttgttgcccaggctggagtgcagtggcgcgatctcagctcactgaaacctctgcctccttgggttcatgccattctcctgcctcagcctcccacatagctgggattacaagtgcccgccaccacgcctggctaaattttgtatttttagtagacagggggtttcaccatgttggtcaggctggtctggaactcctggtctcacatgatccacctgcctcggcctcccaaagtgttgggattacaggcgtgagccaccgcgcccagcctctgttgagcatattttgaggttctcttggtgccagtgatatgtacatgtgtccccatcgcaccatcgtcacccattgaggtgacattggtgcctctcctcggggtggatgcctccctctgtttccagcaacttctgaaggattttcctgagctgcatcagtccttgttgacgtcaccatcggggtcacctttgctctcctcagggctcccaggggaggcccgaatcaggcagcttgcagggcagggcaggatggagaacacgagtgtgtgtctgtgttgcaggatttcagaccctgcttctgagcgggaggagtctcagcaccttcagggtggggaacccagggatgggggaggctgagtggacgcccttcccacgaaaaccctaggagctgcaggtgtggccatttcctgctggagctccttgtaaatgttttgtttttggcaaggcccatgtttgcgggccgctgaggatgatttgccttcacgcatccccgctacccgtgggagcaggtcagggactcgcgtgtctgtggcacaccaggcctgtgacaggcgttgttccatgtactgtctcagcagtggttttcttgagacagggtctcgctcgctcacccaggcgagagtgcagtggcgcaatcacggctcgctgtagcctcaatctccctgggctcaggtgatcctcctgcctcaccctctgagtagctgggactacagacacataccaccacacccagctagtttttgtgtattttttgtggggggagatggggtttcgctgtggtgcccaagctgatctcaaactcctgaggcacaagcgatccacctgcctcggcctcccaaagtgctgggatgacaggcatcagccgtcacacgcagctcaatgattttattgtggtaaaataaacatagcacaaaattgatgattttaaccattttaaagtgaacagttcaggctgggcgtggtggcttatgcttgtaatcccagtactttgagaggctgaggtgggcagatcacctgaggtcaggagtttgagaccagcctggccaacatgatgaaatccagtctctactaaaaatacaaaaattagccgggcatggtggcaggtgcctgtaatcccagctactcgggaggctgaggcaggagaatcgcttgagcccgggaggtggaggttgcagtgatctgagatcatgccactgcactccaatctgtgtgacagagcaagactctgtcttgaaaaataaataaataaaaaaaattttaaaaagtgaacaattcagggcatttagtatgaggacaatgtggtgcaggtatctctgctactatctacttctagaacactttcttctgccctgaaggaaaccccatgcccaccggcactcacgcccattctcccctctctcccagcctctgtcaaccactaatctactttctgtctctgggggttcacttcttctggacgttttgtgtgactggaatcctgcaatatgtggtccctgcgtgtggcttctttccatagcattgtgttttccagattcacccacacattgtcgcacgttatcagaatctcattcctgactgggtgcagtgggttaggcctgtaatcctaacattctgggaggccaaggcgggacgatcacttgaggcaggagtttgagaccagcctggccagcctagcaagaccccagctaccaaaaaattttaaaagttaactgaacgtggtggtggtgggcacttgtggttcccagctacctgggaggctgaggtgggaggatcgcttaagcccaggaggtcaaggctgcagtgagctatgatcgcaccactgcactccagcctggacaacagagcaagaccctgtctgaaaaaaaaaacaaaaaaaaaagttcctttctttttgtggctggatgacatcccattgtatggccacagcacattttgtttgtctgtttatcgggtggtgggcagtggtttccaccttttgtctcctgtgaataatgctgctgtgaacatttgaattcaagtttttgtttgaacacctgttgtgaattatttggatatatgtgtaggggtaggattgctgagtcctatggtaatgttaggtttgacttactgaggaaccattaaactgttttcaacagtggctgcgccgttctgcatccccaccggcagtgtgtgagggttctgactttacctcctcacaaacgcttcttttccatttaaaaaaatattcagccaggtgctctggctcacgcctgtaatcccagcactttgggaggccgtggcgggcggatcacctgaggtcaggagttcgagacgagcctggccaacatggtgtaaccccatctctaccaaaaatataaaaattagccgggtgtggcagcgggcgcctgtaatcccagctacttgggaggctgaggcaggagaatcacttgaacccgggaggcagaggttgcagtgagccaagatcgcgccactacactccagcctgggtgacaagagtgaaactccatctaaaataaaacaaaaataaaaataaataaaaatttattaaaacattcatcacagccagcctagtgggtgtcccatgtggctttgcctcgcatttccctgataactaggatgctgagcgtcttgtcccaggcttgccacacctcagcactttgagatacgtcgcacagtccccatttgcgaacgagaaatgaggtttagggaacagcagctgtgtcatgtcacacagcgagcagggggtctctgagccgtctgaccccacagccgaccaagctccaatccttaccgcctcctagtgttgtggatgtagcccagggtgctcccacatttttcagatgagaacaccgaagctcaaaacaggagcgttttgtccacattggatacacgatgtctgtggtttggtcctgaagtcactttatatctcagtggtccagactggagtaggacagggggttctggggaatggggaaggtgtctcaggtgaaaggaaggaattccagattctccatactgtccttgggaagttagaagactcagagggtctggcaaagtcagacaaagcaagagaaatgcagtcaggaggaagcggagctgtccaggaacaggggggtcgcaggagctcacccccaggaactacacttgctggggccttcgtgtcacaatgacgtgagcactgcgtgttgattacccactttttttttttttttgaggtggagtctcgctctcttgcccagtctggagtgcagtggcacgatctcggctcactgcaagctctgcctcccgggttcatgccattctcctgcctcagcctcccgcgtagctgggactacaggcgcctgccaccgcgcccggctaatttttgtatttttagtagagatgggatttcactacattagccaggatggtctcgatctcctgacctcatgatccgcccgtctcggcctcccaaagtgctgggattacaggcgtgagccaccgcgcccggcccgatttcccactttaagaatctgtctgtacatcctcaaagccctatacacagtgctgggttgctatagggaatatgaggcttacaggccatggtgctggacacacagaagggacggaggtcaggaggtagaagggcggagagagggaacaggcggaggtcacatccttggctttcaaaatgggccagggagagacaccctctgagcatggtaggacaggaaagcaagattggaacacattgagagcaaccgaggtggctgggcgtggtggcttacgcctgtaatcccaacactttggaaagctgaggtgggtggattgcttgaggccaggagttcaagaccagcctggccaacatggtgagaccccgtctctactaaatatacaaaaattagccaggcgtgatggtgcatacctgtaatcccagctgcttgggaggctgaggcaggagaattgcttaaacctgggaggcggaggttgcagtgagccgagatcccgccactgcactccagcctgggccacagagtgagactccatctcaaaaaaaaaaaaaaaaaaagataaaaagaccaaccgaggaattgaagtgggggggcgtcacagtagcagaagggggatcgtggagcaggccaccctgtggtcatgcactggaagctcattacctgacgatttggagctcatcactgggggcctaaggagaatagatactgaaggatgaggagtgatggcgcggggcacgggtgtctttggtggccagaacttggggactgctggggtgcctcactgcaggccttctcagcgccctttatatgcttacacaggctgtttctaagagggggatacattgcataagcgttttcagactacctcatcatgggtccctttctttaccctctgtggccctggtggcgcactctctgggaaggtgcaggtggatgcccagacccgccctgccatccacctgcacgtccagagctgacttagcctcgagattgctgctggcacctcctgccccgggacacctcggatgtgcccgtggagatgctggctctgtgttttctgctggagtttggtgcgtcttttcctcctgcaagtggccaccgctcttgggtatgtcctcaggcttctgcgagtcatggctgcttctcaggtccttgcccagcgccaggagcaaaccctcctggcactttgttcaggggtggatgcgccagtgttcctgctgtggacccccatctcacatgagggtcttgggcctgcaggctcgttcaggaaacacccgctgagtacgcagtgtgtgccagctgtgtcccaggcaatggcggggacagtggctgctgctggggttgtggtggcttctggggactctggggacagctgaggtgcaaggagccacggctccttgaggatgcagttggactccaggtggaagggatggttgggggaggtataaatggggtcagggaggagacacatttggaacaatgggaacatttttaagatgctatgtcgggaggcaacaaggtggccaacccaggtgctgaggagcccacaccagccctggacgtgttttgccgctcacctttgctggggagtggtgggagagaggattccgttccacgtggtggtgtgcgcagctgggctgtgtggagctgggcgctaggaggaaggtgctttctgcggggctagccgggctctgcctttgaacacaatcaggctccaggttttcagcatccagtgcatgagaggacttcacgggcagctgtggctgatcccttgatgaattgggagaagaacaaaggtctatgaaatgaggtttcatgtagatggcattagagacgcccacaacagatttacagagtggagcggagacggcggatgggtctgggaggcccctcctgctggccttgactgtgacagctgtcctgggaatcagcttccaggccgccccagcagcctgactgacacacacaggggttttagccccatcctgcgaccagctgttgccatcatcagtgacagctgggagtggcggtggttccagccctgggcaccctccccacctgctggggcccacccagggcagtcctgacacctacaggttgcttggagccgcatccgagtcctgccccaccacgtgtgaagcccgagtggtcgtgggctgaggtcccctgattgcatccccacttcccttctgcttcacatagctgcctcttctcaccgtttttccagcctcctgggctaggaattccagtgttgtgctggctttgccccaggacacctccttagccctcttcctgagtctagagccccgggggttggaagttctggcccctgggacacctgcagccacactcagcttctcctgtgagcctccagcatgtcccctcaggaccaagccctcacgttcttgcctccccgcccacctgggctcagccaggggaaggcctggctgggagcgtctcccctctgccctgcccttctcccctctaccctgcccttctctcctctgccccgccatggcttttatatcctgtgccacaagacatggctgtgtgtgaaagtggcagggtctggcatctctgtgggtctctgaggcccacgctccagtgccactcttcccacccgctggccgtgccctcatgctggagggacagcccagccctctcccgaaccccagccccatgtgcccagctgcccccggccctctcccctggaagccggggtcactccagccgtatgccatggtggggacatcctgcttccttggccttccagggaaggtcctctttccaaatggcgacacctggtccctgcctggaggctggaagctgtggcccttgtatgcccctccagggtctgtgcgctcggttggcccgagttcccatcaccgtcatcatcaccatcatcattgtcatttcgcttgtctgtgagccggcctggtctcccagagcagagaccctctgaggtccagcctgagttggggtctccgtgctgacccctgacggggactcaggacgtaccaggtctgggtcaggagtgacccccaaacctcgtgccctttgacaggcacccctgacttttgctaagtgggtggaggtgacatcacttacagcgggagtgatgggacagggtctgttggctgcactgtgctcccagggatctggggagaggctatatccctgggctttggcactgcagagctgtgtgtgtttgtgtgtgtgtgtgtgtgtgtgtgtgtgtgtgtgtgtgtgtgtgtgtgtgtttgcgtgcgcgcacatgtgtataagatctttttttattacatgaagcaagataactgttgctgtttccttttgggttttgtgttcaacagagtggggtacttcttccctcagacaacagaactctcccctttaaacacgtgctgtcagagggtgggtcttgggctcatgtctgtttgcacagccgagtcagaggaaacacagggttcttcataaaaacactgcacagcaggcgactgtccagagtcagcctgcaggacggcagcagccctgcccctcagagcacagctagggtgggctgctttgggatctcccgtcattccctcccagctggcagccggcggccggcccattccttggtgtgctggtcaggggggcgtgcgcctgctctgctcaccctgggaatgggacagaagctggcagctcggagaggacagggctggacccttgggtggcctctggctggaccatctcattgtcctcagacacagcctctcgggtctagtttcatttcctgaaaaacaagtgcacagaactagagcaggagtcgagagctacggcccccgggccagatccagccctgccacctgttttcacaccatgctcaagctgagtgggttttacattttttaattacttgaaaaaaaaaaagccaaaggaggtttcatgacccatgaaaattatatggaattcaaaaaaaaaaaattatatggaattcaaatttcagtgtccataaataatttcttgagacagggtctcgctctgtcacccaggctggagtgcagtgctatggcatggctcgctgtacccttgacctcccaggctcaagcgatcctcctgtctcagcctcctgagtagctgggactacgggtgtgtgccaccaagcccggctaatttttttttaattttagtaaagacagggtctttctatgttgcccaggcttttctggaactccatcttggcctcccaaagtgctgggattacaggctcgagccacggagcccagcctgtttttgttttttcactgataaagttttgccgggtgtggtagtgtgtgcctctagcgatttgggaggctgaggtgggaggatcgcttaagcccaggagtttgaggctgggctcaagtgatcaggaggtgaactatgatcatgtcattgcattccagcctgggtgacagagcaagaacctatctcttaaaaatatatatttaaaaagtattgggtgtggtggctcacgcctgtggtcccagctacttaggcatctgaggtgggaggatggcttgagcccaggagtttgaggttgcagcgagccaagatcgtgtcactacactctagcctgggtgacagagcccagaccctgcctctttaaaaaaaaaaaccaaaaaacatgtattggaacacagccatgcctgttcagtcacgtgctctccatgctgctttctgctccagagacccttatggcctgaaagctgaaaatattttctatcctttacaaaaaagtttgctgacctctgtcctggaaaattcatctcccaagttctcttccggcactggcgttcctgggtgtcctaaatttggcccctgttatttctgaactctgttttggctctgttccctcccaggagccaggacaggcacgttctctgcatcttgtcccctgacgcccagaggcttggctcggctcaggcattcttggaaatatctggctccaggaaaggcagaggcctcctgagtcagcccagagggaacctgccccaggtctgggggaggcctgacccagcagagtggcttttgccgatgggttgggccggtcaagatgtgctgaaagttgtcctcagaaggccactttgggattccttcctccagtattagagcaactgagagctgctcattgcaagcctgatgttttcccagttggccgggtccaccgggtgccctgggattctgggatctgggtggaaagtagggggcttgggggagtgtcctgggttctggaatccaggtggcaagtggtgaggttcagggagtggcttctgagccaccataggggtctctgtgggaggctctgcccatccaggagattccgcaggccctgccggcccagagccagcgtcttgcgcttgccgaggctacagccagccccagccgggtggaacagcccgtcgcctcctctcactttgttttggggccacctgggagtgtggagcaagggtagagagggaggaagtggctgccggccgctgcccagcacccttgtttgccttgggccctctgtgggctcctttttattgctcttcaatgaagccagggaaatggacttccttgcctcacttcagttcaacatgtctggaagtttggtattaaaattaagaaagtgtggaaatagagcaagaagagaaaaatctctccaagagataatagtgacctctgagctgggcgcggtggctcacgcctgtaaatcccagtactttgggaggctgaggcgggcagatcacctgaggtcgggagtttgtgaccggcctgaccaagatggagaaaccccgtctctactaaaaataaataaataaataaataaataaatacaaaattagccaggcatggtggcgcctgcctataatcccagctaaggcaggagaatcgcttgaacctgggaggcaaaggttgcagtgagccaagatcacgccattgcactctagtctgggcaacaagagtgaaactccgtctcaaaaaaaataaataaataaaaaataaaaatagtgacctctggccaggtgtggcagctcatacccgtaatcccagcactttggaaggaaggccgagatgggcagattgctttagcacaggagtttgagaccagcctggccaacatggtggaaccccatctctacaaaaatagaataaaatttaagaggtaatagtgaccttttggtagatcgaaacctggattgctttctttttctaaatgctgattcttttctttgtggtgtttgtgttctgtgccgatgtccctcccccagccctgttattgtgagtggaagaaggggaaagggttcgcccgctactgtgagcccctcctctcacgctgggtgtccttggagaagcctgcacttcttcattgtacgccagggctgggtccctccctggagtggttctgtgctgctgggatggggccaacccctcagatgttttctgagtgtcacacacaggtgtgtgcattcatggcctttgcgtgtcttcctgttgtggaggcaaaaatgtgaagaaccctagatgattttgggaccagggctccatcacctgctgttcattgcacaccggagcatccaggcatgggtggagagctcagacttccaggcacggtcgcaggggctggtctaaccatgttcccgcccgcctgctcgtcagaaccgcctgttgggagctgttatcatgataccatacctgggccctgggctatccgattctgacttaattgctccaggttggggccaggccgttgtttgctgttttgttgtttcttctgtgacgttagccactgggctaatctgagcccctcagttacaggtggagaaactgagacccatgggggtgcaaggacttgccgaggacccagagccccttgggggcagagctgaggcggggcctggctttgggtcccagagcttccagtccccttcccgctctcctaacagcttttttttttgagacaagatctcaccctgtcacccaggctggagtgcaatggcatgatctcggctcactgcaatcttcgctagctgcgttccagcgattctcctgcctcagcctcccgagcagctgggattacaggtgtgtgccgccatgcccagctcgtttttttttgtacttttagtagagatagggtttcaccatgttggccaggctgatctcgaactcctgacctcaaatgatccgcctgcctcggcctcccaaagtgctaggattacaggctgggatcacactgtgcctggccctagcagctttgtcctgtgccatccaacaacagatgaccgaagtctttgtttcttaacatgcattccatctgccttacagttttgccacctgcaaaacagaggacttgtcgcttttctggtaagctggaaatgtaatctggtagcaggaggcctgtggaagcttgcctttaatggccttgtgtctctttcatcctgtcctgagagccggagaacttggatgttgcacctaactcaaccttcctgttaacatacagttctgcaggctcatggatcatcagaaccacgtcctatctcacgcggctgtatgcttccgttggttcaggtgtttttaccttgacagtattttctcctcggtggcttttgcggtggttgcttttaatcagcattgactcttcaagaaaaatatttagctgctacatctcagaggagacagggtggaaagcatctgagacctgcaggctcagacttagaaccagaagtgccctcagagttcatccggccctgacccagcgggaaatgagttcacagagaagcgggagaactttgccccaggccctgccgttgctcataactgccccaggtccttacatttgctccaggtcctgccccaggccctgcagttgctcataactgccccaggtccttatatttgctccaggtcctgccccaggtcctgcagttgctctgtgtggtgggtgtgatctggagccctccgcccattgctgcacctggggcaggcattgctaattgatcccaggactccttcctgcggagcacgccctggttctccaggcagccgctgcctgtcagcctgcagtggttcgggagaggacacctgcttgcctggtctgttccaaatcttgcttctcatcccagcacaggtagggggtgctatgggaaagggatcctcagttggccctgtcactgctctatcagctggggacgtggcatcctagtgaaaacatcatggccgggcgcggtggctcacgcctggaatcccagcactttgggaggctgaggagggtggatcacttgaggtcagaagttcgagaccagcctggtcaacatggtgaaacccatctctactaaaaatacaaaaattcgccaggtgtggtggcgggtacctgtaatccgagctactcgggaggctgaggcaggagaatcgcttgaacctgggaggtggagcttgcagtgagccgagatcttgccactgcactccagcctgggcaacagagtgagacgctgtctcaaaatctcaaacaaacaaacaaacaaaaaacaaacaaacaaagcgtcatttatccagcacccctggggaaccatgctacctggtgttttatggtacctggcaaggtgcaggtgaagttgctgctcttgggcattgaacccgtcttgtttggggcagctcaggccccaggcagggtccgggttggctctcgttggtgtggccctggcccatccagacctatatttctgccgtcctgcaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggtgagtccggggggtcccaagccatggctcagccatgcagacttgcatgaggaggaagtgacgggtccatgcctgggcataagtgttgagctcaggtgccccgacctggggaagggcaggacaggaaaggtgacagtatctggccaaggacagatgggaagggaccaagggagctgattagggagtggttatggactaggaatgtcggtaacaatggttagaaagtgactaacatttgttgagcacctgctgtgtgcccggccctggccgggagccttcgtgcccacagtgaccccgtctgcaaatgtagttccttgccctactcgcactggggagcaggacgcagagccgtgcatctcacaggtgccaagctcaggactccctcctgggtctgcctgggctgggctgtgcttgttgcccctgtggcccacgcatgtgcaccttccacctgaaagccaggatcttcaggacgctccccgaggaggtcgttgtctggcacaatgatttgtctcttcctgaaaaggtgacagagttacactggagagagcagcatccaggtgcggcagggacaggcctggggctcgcgggcagggactctgtgtcctgccggggtcccacactgcacctgcttgtcagaggcactcagtcaatctttgctgatgaaggatgagaggacagaggacgtgatgcttgctgctgcattgcctgcagtcctgggtgagatgcccgggttgactctgctgcccgtcgggtggatgtgatgtcagatccccggctttaaaatacgagggagctgggaattgagggagcaggttggggcagaaagcacagccccgtggaagcctggagctgaggcagtgtgggcgacccctggagcagtgagtgcttccttcatggccttcatcgcaccctgcagtcctcatgtaggggatgccatccatgaatttagttttcccagcctcctttaaaaacgcgttcatgctggggccggggcagtgcagtggctcacatctgaaatcccaccactttgggaggccgaggcgggtggatcatgaggtcaggagatcgagaccatcctggctaacaaggtgaaaccccgtctctactaaaaatacaaaaaattagccgggtgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaagtacaaaaaaaaaaaaattagtctgggtgtggtatcacgcgcctataatctcactactcgagaggctgaggcggagaattgcttgaacccaggaggtagaggttgtagtgagcccgtatcgtaccactgccctccacctgggcaatagagcgagactctgtctcaaaaagaaaaaaaaaaaaagaacatttatgccaggtgtggtggctcatgcctgaaatcccagaactttggaagactgaggcaggaggatcacttgagcccagaaatttgagagtgtcttccctgggcaacatagagagacctcatctctaccagaaaaaaaaaaattagcccggcatggtggcatatccctgtggtcccagctacttagggggctgacgtggcaggatcacctgagtctggaggcagaggttgaagtgagctgagatcatgccactgcactccagcctgggtgacagacagagaccctgtctcaaaaaaaaaaaaaaaaaaaagcatttactatccaccatggaaggtgagactgacctgtgagtgattgttcaaagaacaaaaaataaaccccagagataagacaaaagggtgcctccatgggggtgtgatttaaagctgagaaattgggcttcttccccctcccctctcaccccgtggtttgctaaaggagatgggaaaaaggattctttttttggctgaaatatttaacactaaattaaagccaattttaacagcactttggttgatgagtgaaattaacagactggccaaaaataaacgaacggtctgtactatgtgaaaaagaggcagctttggccatgctgggccaatgtgagttttcagggttgctgggaatgtctgtgaatcggaggaagggcctagctgggactctcaggagccaaggccctgaggggcaacttgcctggtccctgccctgaggcgttcactgctttcttcctgggccagatcacaggcccggaggctggaccactgggctggcactcttgccgagctgctccctgacttcctgaccatgctcctttcagcagccttgctgcactttagtttccttgaatgaaaaatggggatgagaatagctcctacctccaaggtgaatggagtgagttcggacaggtgactccctgggaccagtgcctggcgcctgacaaggtccagtcagagcccgcactgctgttactgatacccttggctgtaccaggggagaacttggttgccattgccaggtgttctcccaccacccccactactgtccctgtttgatgtgtggcgggaataaagctgtgcacattggagcttttggcacatcctggctttcaggtgaaaggtgcgtgtgtgtttgagggtttagcctggccaacccagccatgaggtcggacctgacctgggggtgagtcctgagctcggcacccctgagctgtgtggctcacggcagcattcattgtgtggcttggccgcacccctttccctgctgggctgttgatgtttagactggagcctctgtgttcgcttccaggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaaggtagcgtgggccagaacgtgcacacaggcagcctttatgggaaaaccttgcctctgttcctgcctcaaaggcttcagacacttttcttaaagcactatcgtatttattgtaacgcagttcaagctaatcaaatatgagcaagcctatttaaaaaaaaaaaagatgattataatgagcaagtccggtagacacacataagggcttttgtgaaatgcttgtgtgaatgtgaaatatttgttgtccgttgagcttgacttcagacaccccacccactcccttgtcggtgcccgtttgctcagcagactctttcttcatttatagtgcaaatgtaaacatccaggacaaatacaggaagactttttttttttttttttgagacagagtcttactctgttgcccaggctggagtaccgtagcgtgagctcagctcactgcaacctccgcctcccaggttcaagcgattcttctgcctcagcctcctgagtagctgggactacagacatgcaccaccacacccagctaattttttttatatttttagtagagacagggtttcatcatgttggccaggctggtcttgaactcctgacctcaggtgatctgcccgcctcggcctcccaaagtgctgagataacaggtgtgagccaccgttcccggcataggaaaactttttgccttctaaagaagagtttagcaaactagtctgtgggctggccttctgattctgtaaagaaagtttgattggtggctgggtgcggtggctcacacctgtaatcccatcactttgggaggccgacgtgggcatatcacctgatgtcgggacttcgagaccagcctcaccaacgtggagaaaccccgtctctactaaaaatacaaaaaaaaaattaaccgggcatggcggcgcctgcctgtaatcgcagctactcaggaggctgaagcaggagaattgcttgaacctgggaggcggaggttgtggtgagctgagatggcaccattgcactccagcctgggcaacaaaagtgaaactccgtctcagaaaaaaaaaagtttgattggtgtaaccaaagcgcatttgtttatggattgtctgtggcagcttttgttctgccgagatgagttgtgacagatctgtatgggctctaaagcctaaaacatgtgccatccgcccctttacagaaaaagtgtgctgacctctgttctaaagtattggacaactacaatgtttgctcatttattattctatgatttgttttctgctttttgttgttgttgttgttgttgagatagggtttccctctgtcactcaggctggagtgcagtggtgtaatctcagctcactgcagcctcgacctcctgggctctagtgatcctctcatctcagcctccctagtagctgggactacaggcacacaccaccactcctggctgattttttttttttttttttttttttgtggagacagggtttccgcatgttgcccaggctggtttcaaactcctaggctcaaacacccacctcagcctcccaaagtgctgggattacaggcgtgagccaccatgcccagcctattctactgtttgtattacatagctttaaaagattttttatgactttaagtcacaagggttctttgtagaaaaaaatatatatataggaaagtataaaaagaaagtaaaaattgtccataacctctccagccagagacgaccgttgctgacacctcagcatattgcctttaagtcttttttctctaagatagcatttctcttcatcacagtcatatgctacgcagaattctgtatcctgattttttcacttgacattacaacaggtatttgatggcgctgtgacaaactctttggcacaatcttttaaatgtatgaaatactccactgcacagatgtttgcttttaggcttaactgttcttttattttgcgtgtgctggttacagccgggcacagtggctcatgcctgtaatcacaacactttgagagggtgaggcaggaggatcacttgagcccagaagtttgagaccggcctgggcaacatagtgagaccccatctctacaaaaaacttttttaataagtcgggcgtagtggtgcatagctgtagtcccagccaccaaggaggctgagttgggaggattgcttgagccccaggaggttgatgctgcagtgacctgagattactccactgtactccaacctgagcgacagagcaagacttgtctggggaaaaaaaaaaaaaaaatatatatatatatatatatatatatacatatatacatacacgcacacacacataatataaaaatatatatttataaatatataatatataatataaaaatatatatttataaataaaatttataaattatatttataagtaaatatataatatataatataaaaatatatattatataatatataataaaatatataatataaaaatatatatttataaataatatataatacatacttataagtatatatttaaaatatatgtaatgtatattttttaatgtatgatatataatatacatttataaatacacatttatattattttatataaaatatatataaaatctccaagttgctttttccaaaaaggtgtcttgctgcatttcaaacattcatttaaaaacttgaatgctggtgatctggtccagaatgtgttcagtagctgctgccagtggccaagcatctcgggagatgtctacaaaacacgctggttctggcctggcgtggtggctcacgcctgtaatctcagcactttgggaggctgaggcaggtggatcaactgaggtctggatttcgagaccagccttgccagcttggtgaaaccccatctctactaagaatacaaaaaaattagccaggcgtggtggcatgtgcctgtaatcccacctacttgggaggctaaggctggagaatcgcttgaacccagggggcagaggttgcagtgagccgagatcgcaccattgcactccaggctgggcaagaagagcgaaactccgtctcaaaaaaaaaaaaaaagatgctggttcctaaaatgtggcccttttcctcctcacctgctgccagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaaggggtaagtgtttgcctgtcccgtgcgtccttgtgttcacctcgtatgagacagtgcgggggtgccaactgggcaaggtggcaggctgtccgtgtggccctcagtgattagagctgtactgatgtcattagccttgatggtggccaggactggtagggccctcagaggtcatggagttccttcgtggagcgggtgctgaggctgtatcaggcacagtgctggctgctttcacctgggccgtctcaccgaagtgtccatggagcctgcgtagggtgggtatctgtgtcgattttacagatgcagaaacaggctcagagaaaccgagtgacttccctaaggtcacatacccagttagagcagagctgggccaggaagtgctgtctcaggctcctgaccaggtctccttgctttgcactcttgccaaaaccatgatccagaactgactttgaggtccccggacctcaggctcctccgaaatggcctcttggaggctgctgagccacagcttaggacccacctcgagaggcaaatgtgctttgagctgccaggcgtcctgggggccctgccttgggcacggggttcagacaggccccagatgtgtggggcgtctttctggacttgagttttcttttctgtgtggtggacacagtgctcaccccttaaagcacctgtgatgtgtgcagcagcccaatccctgcctgtcgcctgttctgctagggaaggaaggaagacttcaggatggcaggacaacagaaagaggtccaggttttagagcaagggcaggtcaaacttagaaaattctggaatgaggatgtgcatttcctcttctggatctgctaaaagaagagggaaggaggggctgctgggggaggagcccagagccgagtttacatccggatcccgcaaggcctcccctgccctgaggtcttgttttgtgatgtgcttgtgtccatcctggtttctgccgtgtccccaacatccggccaagcttaggtggatgttccagcacacactcaccctgtctgtgcacctgtttttgtgtccgtaagtgggtatttactcaccttacgagtgagccactgtgggaattcagggaggtggcgcagtgaccacccctggagggatatgtgtgtggcaggggtcgagggtctcgcccttccctgcttcctgcgcgtggctttctccaggacggggagggctgagctgaagaggtggggacagttgcgtccccccgccacccactgtcctgcggtgagagcagactcactgagcctgcccttctcccttgtgccttccagctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtgagggccgggctggggccttctggtcatggagggcggggcagccgggcgttggccacctcccagcctcgccgcacgtaccctgtggcctgcaagttccccaacctggcaggagctgtggccacacccacgactgcccagcagcctcaccctctgctgtgggagttgtccccgtccacccctgggtgcctttgctgcagttatgtcgggagaggctctggtgacagctgtttcctgtgcacctgctgggcactaggtcccagctaatccctgtgccaggactctaatttcaccctaacacacatggtggttttcattgctggggaagctgaggcctgagcacatgacttgccttaggtcacatagctggtgagttcaggatcccccagagataccagggccagcactcgatccccacccagccctgaaccccaccatgtgctgggattgtgctgggagtgtccacacgcctgggaccccagggctggtgctctcatctcctttttccagatcatgagaatgaggctcagggaagtttgaaaaaaacctatcccaagtcacacagcaacaggagcaggatttgaacccagaaaaggggaccgcacactctgttctgctagagtagttagctgtcctgggtgatatggcaggtgacaggggcaactgtgcttaacaaaggaacccccatcccccctgccaagttgggagactagaaggtcaggggcagaagctctgaagggccaggtgcagtggctgacacctctaatcccagcactttgtgaggccaaggcgggcagatgatttgagcccaggagttcaagatcagcctgggtaatgtagtgagacgccatctctacaaaaaaattttttaaaaattagctgggcatggtggttcatgcctgtagtccaagctacttgggaggctcaggtgggaggattgcttgagcccaggaggttgaggttgtggtgagctgtgatcatgccactgcactccagcctgggcaatagagtgagaccgtctccaaaaaaaaaaaaagaagaagaaaaagaagctctgaggctccaagtccccaggcaccccttggcttgagggcagacaagggaggagagggtcacctgggcagccctgacttttgtcccctggcaaagggaccttcagtgaccttggccctaggagagcctctgagcacgtcagccatgtcgaaccgctcaggaagggcagcaagaatttggcttctgacctctgcctctcctactcgccatctgcactgggtgtggttgtgcccattttacagatgaggaggctggggcatcgaccagctgaatgccttgtcccaggtactgcgtaggcagagctggcagttgaaccccgtgtcctggttgtcgctgggggtgggctgcaccctgacttgtgaggccagtagcaaggtttgcacgtgacttcgtgaccgtcacccagctctgcagcacatcccgtgacccagctcatccaggccgcatgcaaacctgttgccaggcgagaaaccagtcaccgcacagctgtggttgcctgaaatgattaagctcattaatcaccccggagtgaggacagactcagatgaaaaccagcaaaagccctggaaactcatgtgaccctgccaatgagggcggccatgtgcattgcagcctggccgtcactcctcggtacgtgttttggacttaaacgctccggatgtttactgagtgcttgattaataacatggaaggcctggtctcattgctgtgggagtgaaggatgcacagccaggcctgacatgatgagaacaagaacctggagtctcgctgcctgggtggtaatcctggccctgccacttagcaactgtgtgactgtagccaggtcacttaattttgctagatcctgcctgcgcttcagtggatcttgctggttttccaaggtggccaaacactttaaggcattcatgtggtcgctaggctgcagggttgaaccctggctcaccccgcagggcgccgtgtgctctgtggcctggctgtgcctttgctgacaccgtgcccgtgtgtgttcatgcaggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagccgtaagtgcctcatggtcccccgcacctcactccctcgttagatcaggctggttctgggagctgacgctgaaaggagcttctcatctggggttcctgggtgtacatagatggttgggtaggttgtgcactgcacaagctgcatgatgctacctgggggtccaggtccaggctggatggacttgttgcttcatcaggacatagataaatggccaaaactcctcagctggaaggtcctgggcaggatctttgggtgtgaaaaccagtcacaggggaagggtgcttgctcatactgccagcacagtgctgagtgctttccatagcgctcgtttactcctcaagcctggagggtggggagtagcatggtcccatttcacgtacaaggaacccgatgcacagagaggtgtggcaacccatccaaggccatacaactggggtgggttgagccggggttgactgtggcaggctggctcaagagtccctgctcctgaacccttgccaggcagcctggcatcagctcggggaatttttgccctgacccttggaagcaagtgggcctctttgttctcatgtcagtgatgagaagagtgactttcctatggcccctctggagtacaggtgtttcctgttggcgggctcttcccccatgacatcagcagcgagctggttatgattccctacgcagaacttgatagtttataaagctctttgtcatccaggccccgttggagtctcacgcagacctggtcgcaggcggggctggtcttgcctgtcccagctgcatggatggggaacttgaggcttgcaaaggttaaggggctgttcgaggcccaggctggcaggagatgggcctgggccagagtctgggacttcccatgcctgggctgtctttggtcctgttgctcaccatccctccctggggccatgaccttagagagccaaatggaggtgcaggtaacccacggcaaggaggggttgccatgactcagagtccccgtcctgtggccggcagtacctggtgcaacgacttggatttcagaccagccactgtagcccgctgacggtgcgctcgaagtgccacagcttctgaagccaggcaggactcaggccaggagactctgttagctgttgagagggagaggccaacggatgttctggttctgctagagagctggttcttcggatcctggtaccagtgcactgagaggaggcccagcttgattctggggctgccttgtggtggcatgtgctgctcactgacaccctcgaggagtgtcttctctcgggcttgttgactgtgcccggttttccgcagttcactggtgcacacataggcacatagcaaaccgcacacacagtcgtgggtatgagtttcactacattccaccaccagtgttcactaccattacctgccttccgtcttaagtgttcatcatttaaaaataaatttattgggctggacgcggtggctcatgactgttatcccagcactttgggaggctgaggcgggcagatcacctgaggtcaggagttcaagaccagcctggccaatatggtgaaactccatctctactaaaaatacaaaattagctgggcatggtggggcatgcctataatcccagctactcaggaggctgaggcaggagaatggcgtgaacccgagaggcagagcttacagtgagcccagatagcaccactgcagtccagcgtgggcaacagtgcgagactccatctcaaaaaaaaaataaataaataaaagaaaaataaatttatgatctatttcaaaaataacacatgtactttgaaacagcagagacacatatgacacggagaatgaaattccccatagcgcacccccaagagacagccctggtccccccgtctttcccgtggacctccagcggggcagatgctgagccgcctgttgtcgagtggcgtgctatcccgtcctccagctcctctgtggcttacagacacccacctgcagccctgtctttgcctcctctagcgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccaggcaggtgccctgtgggaagggtgcggggtgtgcttcccaaggcgctcctcttgctggtttccaggctgctgcccctgtccttagcagagggaggaaacagaggatggctctgggtgaatgatgacttgggcttcgattatgtagtcacagggtatgaccctgagatgcgtggaaccccgagactgtgattatatgtagaaactgggtttccccgttgtttaagtagtcatggtggggtcagaccccacaggacttttgtcttttcaagaaagaaaatggtcgtgtgtcatgcaggggtagttggtactggttaatccaggtttatcctttattttgtgggaactgtacagtcatttctgctacaatgctgtatatgctcttctgaaagacacctatgcaaaatcgcacagtaaaaatgacacaactcatagggaaagcggggccagggcacagccctcaaaatctccatcaatgacatgtaagaaaagagaggaacctgggaaatagcaaagtgccttttgcacattaaatggttagctatatcccacaatactgtgcattcgtaaacgttaatgctgcaataaatacggcacttcaccttgggaagatctggagttggcttatgagtgtggaagggtgtagcgcatgagtttttgtgaaacactggaaggaggattgtgggaaatcaaatggaaagttctcaccccaggcgtggagaagagtgggtcatggccccagcagtgagcccagggaggtcagagacggaggtgtgtgtgtgggtgtgaccctgcgcagttccctgccggctgtagttttttgcattcgcttaatgtttctcgtggaggaaattgtgcatgagcaaatgtgaaaccgtgctgtgctcaaattgtcctaatacatcattgcattggaacagattggcttttttttttttttttttttttttttttttttgagatggagtctcactctgtcaccagcctggagtgcagtggcatgatcttggctcactgcaacctttgcctcctatgttcaagtgattttcctgcctcagcctcctgagtaactgggattacaggcatgagccaccgcggccggccagatttgcatttttgaaacaactgctaggctgggcgcggtggctcacacctgtaatcccagcactgtgggaggccgaggcaggtggatcacctgaggtcaggggttcgagaccagcctggccaacatggtgaaaccccgtctctactgaatatacaaaaatcagctgggtgtggtggcgggtgcctgtaatcccagctactcaggaggctgaggcaggagaattgcttgaacccaggaggcagaggttgcggtgagccgagatcacaccattgcactccagcctgggcaacaagagcaaaactccatctcaaaaaataaaaaatagaaaaacaagtgctgtagcggaagtgagcactttgcggagtcaggcttgtgtggcctgttccacaaatgatgtgctcacggtggcctcaggcccacctggagtctgcagcatggggcacaacaggttcattagtgtagaattccaggacaggcctggctcctaagcagccttcttttacaaaaactgcagagcccgcctgtatcctagcactttgggaggccgaagtgggtggatcacgaggtcaggagttcaagaccagcctggccaacatggtgaaaccccatctctactaaatatacgaaaattagctgggtgtggtggcacgcgcctgtagtcccagctactcgggaggctgaggcagaattgcttgaacctgggaggtggaggttgcagggatctgagaccatgtcattgcactccagcctgggcaacagagcgagacgccatctcaaaaaaaaaaaacctacagagccacacggcctctttctccaccgagtgttggtgtgggagcttgtgttattgtggtgaaatcttggtactttcttgaggcagagagaggctgagcgcctggagagactttcacatgggtcgccatgtccgccgtcggtttcgctgttgtgctccccatctgaaggctggtgccgtccagacaggctggacgcccctttccaccagatccttcctcccgcagcagtttctagttacgttgtactgtgaggtctgtgtccttggttgatggcaaaagtcagccgaattgaaattcagagccatgcctggctccctggagcttctctcctgggcagctgtgatcattgcctctgctgtggtgtgggtggtggaaatggattcctttcatcttgcttgctacaggtgactgtcacgtggagtcctttggagagagggacgtgttaattgatggatgtggctcccatgctgagaaagctcctgggcgtacattgccttagagtttcattggagctgcgttcttttatggtgtctgctaggcagaagtgatgaagacttggaagaaaacccagaaggttttccacttaatttggaaaatgtgcttttcccctcctgtgtcttttgctaaggtccagcctcctgcagcctccccgctctgtggactctggctttgattctttattaggagtccccctgctcccccaaaagatggtgtctaaattatcatccaattggccgaggttttgttttctattaattgtttttattttttattgtggtaaatttatataacataaaatttgccattttaattgttttgttattgttgtttttgagacagggtctcaccccagtgcccaggctggagtgcagtggtgcgatcatggctcactgcagcctcagcctccagggctccagtgatcctctcacctcagcctctctagtagccgggactacaggcatacactaccacatctggctgattttttgtattttttttttattgtagagacccgctatgttgcccaggctggtctcaactcctggactcaagccatcctcccacctcaccctcccaaagtgctgggattacaggcatgagccacaacacccagccattttaatttttttttttttttttgagatggagtctcactctatcgcccaggctggagtgcagtggcgtggtatcaactcactgcaacctctgcctcccaggttcaagcgactctcctgcctcagcctcctcccgagtagctgggattacaggtgcccatcactatgcctggctaatttttgtattttttagcagagacggggtttcaccatgttggccaggctggtcttgaactcctaacctggtgatccgcccgcctcggcctcccaaaatgctgagattacaggtgtgagccaccgtgcccggcctttttttgtttttgagacagggtcttgccctgtcacccagactggagtgcaatggtgggctcttggctcactgcagcctccgcctcccaggctcaagttgtgcacctccacacctggctaactgtattttatgtagagacagatttcaccatgttgcccaggctgggcttgaaatggactcaagcagtccacccacctcagcctcccaaagtgctgagattacaggcgcgagccaccgcacccagcccattttacctattctgcagttgacagttcagtggcattcagtcagttcacgaggtaaccatcactgccattcatctccagactacttcaccttctcggcagatgtccgaaactgtccgcattgaacacactcctcatctccctctgacagccaccattctactttgtatctctctctgccttctctaggtacctcatgtaagtggaattataccaatatttgcccttgtgtgactggcttctttcatgtgacatggtgtcctcaaggttcatctgtgttatagcctgtgtcagaatttccttccttaaagcctgaataataacccgttgtaaaggctgggcgcggtggctcacaccctctaatcccagcattttgggagtccgaggtgggcagatcacttgaggtcaggagtttgagaccagcctggccaacatagtgaaaccctggctctactaaaagtacaaaattagctgggtgtggtggcgcgcacctgtaatcccagttactcaggaggctgaggcaggagaatcgcttgtacccgggaggcagaggttgcagtgaaccaagattgtgcctctgcagtccagcctgggtaacagagtgagacttcctgtctcaaaaaaaaaaaaaatcatcggatggatggacggaccacttcttgttatttatccatccacgggtgctaggtttcttccacctttggttgtcgtgaataaggccactatgaacatttccttccgtggtgaaggttttgtactagtgaggaaaaggcgtgtttgtggtgttgcataggattctggtaagaaagtttgcactaaccataagtatttgtactacattaaaatgaaagctcaggggccgggcgcggtggctcacgcctgtaatcccagcactttgggaggccagggcgggcggatcatgaggtcaggagatcaagaccatcctggccaacatggtgaaaccccgtctctactaaaaataccaaaaaactagccaggtgtggtggcgggcacctgtagtcccagctacttgggaggctgaggcaggagaatggcgtgaacccgggaggcggagcttgcggtgagccgagatcgcttcactgcactcgagcctgggcaacagagcaagactccgtctcacgcaaaactctgtctcacgcaagactccgtctcaaaaaaaaaaagagttcagggtttatgaaactggccagccgcgtaaagtttgctgtgttgtttttgtgcccgggaggagtgtggccagggtgtcacgtcacacagtacacgtttctcagatggtggttctccagactgctgtcccaaagtctgtttttgcatctggttcccacagacccaccctccacggtgagcctgattttggccagggtagctggaatcttgcttgtctttcagcccggcagctgtaccagtccagggtccacagctagtggcttttaggaaggaatttgttcagttggctttgacacatggccccctagggtccacagctctgtagtgatgtggatgttgttatctacaaagacacatgatccttcgtgtccagatgaaagtgatgatgtctttgcagctgcccagcaaggctgtgtgtgtgtgtgtgtgtgtgtgtgtgtgtgtgtgtgtggtgtgtgtgtggtgtgtgtgtgtgtatgggggagggaggcaccctttccatctgggggtgtgtgtgtgtggggtgtgtgtgtgtgtgtgcgcgtgtgtgtggtgtgtggtgtgtgtgtgtgtatgggggaggcaccctttccatctgggtccaagagactgggcctggggaagacgcttctttttatctacttagagactttgttttatttgtatttttttgagacagggtctcactctgtcacccaggctggggtatggtgatatgagcatagctcactgcagcctcggcctcccaggctgaagcgatcctcccacctcagccttctgaatagctgggactgtaggcgtgcgtcaccatactgagctattgttttttttgtttggttggtttaattttttttgatacagatggagtcttgctatgttgcccagactagtctcaaactcctgaactcaagtgattctcccacctcagtttcccgacattctgggatcacaggtgtgagccactgctgtctccctgttttattaactgctgaaagacctagataaagaaagtctgaaaagacttactatcagagcaccatcctaagatgattccctctgactcaatggagagggaggggagcttttccttcaggcctgggtggcaggagcccaggtgctccaggccccatttgccccaggccaaatcactcgggaacttggatgcagctgtctttcagggtaacccaaaggaaccagatccccgcaggcagtaggcttctgggctgtcctctcctcctacgtcagctcagtaagagcccttcgaagggatgctgtgtcggaggccccaaaagcccaggctcatccctgagatgcacagggtgggctgggcttaggcagcgctcgagcatctcctggacggtgaccccagagagtgtggagacggagagtccttgagagtcactgagagacgtggctgccctgccttcccaagaggggctctgagtcattccccacactcacctgcccctacccaccctcacctggcccccagcctcacctacccccacatctgtaccgatccctttacccgcaccttccctacccaccctcacctcccctgtaccttcacctcccccactcacccgcccctgcaccctcacctgtcccccaccttcacctaacccccaccctcacctgccctcccctcacctggcctccttccgttggggaaggggttgtaaggggcggcccccaaactgtctgtcctggtgccctgcagagaaaacagtacgtgagggccgcagtccaaaagcttgagtcctggaaggtggaggagacagggatgtgttgggaagggccccatggtcttggatcccttctcgactgtcaatggggccttcatgggagcgccagtctagtgatgcacagctgggtgcccggcgggtggctgaggaggcctaaagtccgaggcggcaagagctcttccagaggctgttgtcctaatcgctctggcatactcaggcgggcacgtagttaggagctgattggagaggagagacccccacaccaatactgggatttgactttcaggctaaacttgagaagtgtggcctctgctgtcctgccagagctctccagccagtgcccagggctctccagccagtgcccgggggtctccaccagtgcccgggggtctccgccagtgccaggggtctccgccagtgcccaggggtctccgccagtgctcaggagtcttggtttctttgtcttacagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtaggaggccaacgggtgggtgggggtgctgcccgtccaggcgtgcccgccgtgtcttatgccgaatgccagcctctcacaggctggggagactttccacctggggatccaatgggtggctttccagggtcccaaaagcaaacacaggtttttcacagcccgtccgggaaagcagaaagccccaaggggctggaaggggaaagggggagctctgctgagaggttacaaggcagcgctggccgacgggagttgcagttgataggttttgtatcatccttgttaaacttgaaccctgtgcagaaatcccttccacggcatgggggctgcctgttgactcgctcctgttccaccacagggagctcctgggcttcttcctcccagaggcccccgacgctcccacctgttggtcgtcagagcttctggttggtgggaaggcacccaggaccttgaggtctccagagagaaaagccagggaaagagggagaccgaaacccatgtgacatgaaactcaggctccaaactgagcacgggaacgtttggggacaggagcgcgatggccttcctcagatagctggggggctggcatgaagacgggagctacagccagcacaggtcctgggccgggagcccagagattgagccctgactctgtcacttactggccacgtgaccttgggcgggtggcatagcctcttggagactcagtttcctcattggtaggagtgacggccacagtggtgcggcctctgcagcacacggggggctcggtgggcggaagccccgggtctataaggcggctgtgcaggagccagccgagctggtctcccaacagccagggctccggggtccttagcagctgtggggggcctgcacctgtttcccatggctgctgtcagaaattaccagaagccaggtggctgagagtaatggacacttgttctctcacagttcctgagggctgaagcccgagatcgaggtgtgggcagggccctgcgccctctgaaggctctgagggaacctttgggcttctggtggctccaggcaccccttgacttgtggtcctgtcactccagtctctctgtctggctgcacatggcgtggcctcttctgtaccattgaaggacacttcagttggatttagggcctaccctcacccattgtggtcgtatcttgatccttcatgacatttgtaaagaccctgcttccaaataagctcacattctgaggttctggggtgagcgggaatttggagagcattgttcaactagtatagaatgtgacctgtcagcctcgggcagccctgagaggcaggggctttccacagcccagctgggtgccctgggctccgtgctgtccgaggagacgccatccccacacccgtccttcacccgccaccctcccgcaggtacctgtacttcaccaacatgcaggaccgggcagccaagatcgaacgcgcagccctggacggcaccgagcgcgaggtcctcttcaccaccggcctcatccgccctgtggccctggtggtagacaacacactgggcaagctgttctgggtggacgcggacctgaagcgcattgagagctgtgacctgtcaggtacgcgccccggggcctgccctaaccgcagacacccggccttcattgtcagtaatggcagcagctgccacattgtccgagacctgccgtgagcccagtgccgcgccaggggctttgtgtgtagcgtgttttgtcctcacactgacagctgtaggctggggttctgagtgagccccacagggcagaggcagaaaatgagtctcagagagggtgagcgagctgcttggggccccacagcaggagatggagcaggactgcagcctagcctctgcccccagcacctgcgcaagaagctgctctgctctggactgtgttaggctgcgagggctggagagaaatgagagttggtgcttagagagggggcgcaggtccccatggcttttcctcttatgatgaggtagatgggtgaagggaggggccatgcttgcaggggccagtgaccgaggcccgccgttggaactgatggccttcatcccgagcccagcccaggtgggagcagggctttccgagggcttgtcttgggtcggcctgcttccagggactctgctgcagctcccacccctgtccaaagcatggaatcccccaggctccctggcagtcctgtcaacctctgtcctcccaagctgagtgtggggcaagttctggaggtcagcactgctcaggggggcccacgggctgcttgcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctgtacgtgggggctggcagtggggtgggcagggtggcctctaaacccgacccctggaggaggctggaggccagtgcaagatcctgtgtggcctcagccaggcggtggtctctgccagatgccaactgttgcccgctggggttcagcgacatgtccgaatgtcccgaggcctctgaggttgttttcttttgccgcagaacaaatcaccacgaacagcgttttaagacaacaccaactctttttttttttttttttttgagtcaggatcttgctctgttgcccaggctggggtgccctggtgcaaacacagttcactgcagcctcgacctctgggcttaattaagtgaacaccttgcctcagcctcccaggtagctgggactacaggtgggcaccaccacacctggctaatttttttttgtagagacggggtttccccatgttgcccaggctggtctgcaactcctgggcacaagctatctgcctgctgtggcctcccaaagtgctaggattataggtgtgagccactggcctgacaacacccacggattgtctctcagttctgtaaggcaaagtccaggcacagcgtggctcacctgggttctctgctcagggtctcacggggccagaatcaaggtgtcaggaacgctgggccctcagcggaggctctgtggagaaattagcttccttgctcactcagcaggtagcagttgtgggatcgaggttctgttttctctctggttattggtcggggaccactctcagctcctagaggccaccacaggtccttgccccgtggccctctctgcctcagcagtgggggctccctgcgtcagtccctcccacaccttgagtctctctgatttgcttctaaagggccctgtgattcggctcagccacctttagattaggttagcctcccctttgatagactccaagtcggctgattaataaccttaatcacatctgcagaatcccttctgccacataaggtcatgacgccgtgctggggactggggtgggaaattacggggtcatttaggattctgcctgccactgccttgctgtgtcccagggcttgggggaggggcctccacagctgggaccacagtccttcctcccctccatggtaaccatctgaggattacttgagaccagcctgggcaacatggtgagaacccatccctacaaaaaatacaaacaaaaagggaccaggctgggcttggtggctcatgcctataatcccagcactttgggagaccaaggtgggctgatcacttgaggttgggagttcgagaccagcctgcccaacatagtgaaatcccgtctctactaaaaatacaaaaattagctgggtgtggtggcaggcgcctgtattcccagctactggggaggctgaggtgggagaattacttgaacctgggaggcggaagttgcagtgagccaaaattacgccactgcactccagcctaggcaatagagtgagactccgtctcaaaaaaaaaaaagggccaggggtggtagtgacaaagagaccctatcccaaaaaaaccgaacactgaatccttgagactgagtaaggacactgtgaaatttttctgggtggggcagggaacagagcgtcttctgtcatttcttccacctgggtgtggtcagctctccctccaagctgcctcctcttcttctcattgtccgggtgttggacacatttggttaactggatagaataacgcgagttcccagggacttggtccatttgctattttattttattttattttattttattttatttatttatttatttatttatttatttattgagatggagtttcgtttttgtcgcccaggctggagtgcagtggcgcgatctcggttcactgcaacctctgcctcccaggttcaagtgattctcctacctcagccttccaagtaactgggattacaggcacccaccaccataccaggctaatttttttgtatttttagtagagacgggttttcgccattttgcccaggctggtcttcaactcctagcctcaggtgatccacgcacctcggcctcccaaagtgctgggattacaggcatgagccaccacgcctggcaccatttgctattttaattcccatgtgtattagtgtcccacggctgctgtaacaaatgaccacaaactggatggcttaaagcaacagaaatggattcccccaatgtgctggagaccagaagcctgcgaccaaactgttgggagggctgtgcttcctctgggggctccagggaggatctatttgttggcccttccagtgctgtgggtgccagcgttccacacttgtggatgcgccgcctcaacctctgcccatcttcatgtgtccatctcctttgtgtctgcgtctttacctcttcttcttgtctgtgttgcctcttataaggacgtttgtcattgggtttagggcccacccaaatcatccgagatgacctcgtcttgagatccttaacctgcaaagaccctttttccaaaaaaaggttatgctcacagattctaggccttaagacatgggtgtatctttctggggggcactatccaaccccttatacaatgaaagacgggaagagggccaggtgtggtagttcacgcctgtaatctcagcactttaggaagctgaagcgggaggatcacttgagcccaggagtttacaagtagctaggcaacatgatgagaccccatttctacaaaaagtgaaaaaaaaaaaaaaaaaaaaaaagccaggtgtggtggctcacacctgtaatcccagcactttgggaggctgaggcaggcagatcacgaggtcaggagattgagaccatcctggctaacacggtgaaaccccgtctctactaaaaatacaaaaaattatggccgggcgcagtggctcccgcctgtaatcccagcactttgggaggccgaggtgggtgaattacaaggtcaagagatcgagaccatcttggctaacacggtgaaaccccatcaagatcacaaggtcaagagatggagaccatcctggctaacacggtgaaaccccgtctctactaaaaatacaaaaaattagccgggcatggtagcgggcgcctgtagtcccagctgctcgggaggctgaggcaggagaatggcgtgaacccgggaggcggagcttgcggtgagccgagatcgctccatgccactgcactccagcctgggtgacagagtgagactccgtctcaaaaaaaaaaaaaaaaaaaaaaaaaaaagaaaattagccaggcacagtggcaggtgcctattgtcccagctacttgggaggctaaggcaggagaatggcatgaacccgggaggtggagtttgcagtgagccgagatcatgccactgcgctccagcctgggcgatagagcaagactctgtctcaaaaaaaaaagccaggcatggtggtgcatgcctgtagtcccagctactcaagaggctgaggcaggagggttgttcgacccacggagatcaaggctacagtgagccatgatcgcaccactgccctccagcctgggtgacagagtgtgaccctgtctcaaagtaagtaaataggaggagagacaagtgggcagttcagactgatggtatgggcacagtagagactggtgcagacaggctggcctgtgatgtcaagcaacttctgtaattgtttccggcatccatttgtgtgtcaatttccgtgtcagtaggaagactctgtaggctgccaagaggaataagtgggaggatcctcccagagaggccgggcctgcaggagggccagttctcatgagttctcatttggcccctaccctccaggctgtggttctgaggtgggagacagagcctgacctctgtttgtcttgttttgtctttgcagcagcccacccatgtgcccgtgacaatggtggctgctcccacatctgtattgccaagggtgatgggacaccacggtgctcatgcccagtccacctcgtgctcctgcagaacctgctgacctgtggaggtaggtgtgacctaggtgctcctttggggtgatggacaggtacctgattctctgcctgctaggctgctgcctggcatccttttaaaatcacagtccctgtggcatccagtttccaaagctgattgtgtcttcctttgccctcctttcttttctactatgtgcattcggtgctatgaattttcctctaagtactgcgtttcctgcatctcacaaattttgttacattttcattttcaggtagtttgaatatttttacacttctcctgagatgacatctttggctcatgtgttatttagaagtgttgcttagtttctaaagagttggggcttttccagctgtctctctgcaactgatttctaatttaattctactgtagtctgagagcttattttatatgatttctgttattttaaatgtgttgggtgtggtgtttttgttgttattgtttttgtgtctttttgttttgttttgcttcgtttgttttgtttttgagacagtgtcttgctctgtcactcaggctggagtgcaatggcgcgatctcagctcaccgcaacctctgcctcccgggttcaagtgatcctcttgcctcagcctcctgagtagctgggattacaggtgcacgccaccatacccagctaatttttgtatttttagtagagacggggtttcaccatgttggtcaggctggtctcgaactcctgacctcgtgatccgcccacctcggcctcccaaagtgctgggattataggcgtgagccactgtgcctggccattaggtgtgttttatcacccagcatcatgcagtttatcttggtgaatgttctgtgtactcttgaaaagaatgtggattctgctgttgttgggtggagtgttccagaaacatcaattagatccagttggttaatagtgctcatcaggttgtctctatccttccttcctgactgcctgcttgagctgtcagttattgacaggggtgtggagtctccaactctaatggtggatttgtttatttctcctagtagttctatctttttctctccttctacccttgatcctcttctccccctagggcttcctggtgttagtggtgggagagtggggtagtgaagaacctggactttagggccaaagaggccagggttcaaatcctggctctgtcacttcccagttgagtgaccctggctggtgcctgaatctctgtgagcctccacttcctcctctgtgaaattgagagcacttacctggcaggctgtcatgggcatcaagtaacagggcactccacctggaccctgacacgtgatgcacaggaatgccagctgctatgccatgggtgtggcagtagtaataaagtgaccatctgtatcctcaccacagtgaagcctgtccagggctttctctcctatgcccccatgcctccaggtggccttggatcctgttggttctgtgctctgctcagcgacctttctcccgtgggagttcctgggggttcagcttcatcctacagacagcagcacacactggctgtgcaccctttttttttttttttttttttttttgagatggagtctcgcttttttcgcgcaggctgaagtgcagtggtgtgatcttggctcactgcaacctctacctcctgggttcaagtgattttcctgcctcaccctcccaagtagctgggattacaggctcccaccaccacgcccggctaatttttgtattttcagtagagatggtgtttcaccatgttggccaggatggtcttgaactcctgacctcaggtgatccgcccacctcagcctcccaaagtgcagggattacaggcgtgagccaccacacccggagtgccggttgtttttagcagtttgtcttgttcctggagagactggctcctgcccaggagctcggggagtagggccgcggggtgctgcctcacacctcgagtttggccgtaagcagaggggacattttgtgactgtccccctcctgagcttcccagcagcttttctccaagttacagcccaaaagctcaggtggatttgcaacccaacggtgtctgtgcacctcccactgatgcccgaactgccctggccaagaaacggggccgtcagaacgctgcactaactgcagccttgggcctccatgccagaggccatgcccttccatccaccaccccctggcctgggccctgggccctcctggctcgggaactccaggccccttcctcacggctcgagagacgtgtatttaccgcacaggtgcttgtcattctcttgtggcctcttctccagggagatcacagaaggacagggcctcactgaggtctcggacatggaccctttgatagtggcaggagccaggctgggcaagaggcggccacagtcacctcagcagtgccatcaccaccgccattcagcccttccctgagccgggcgcgcccctggctctggccccagtgtcccagttacagctcacaggagcttgtggtgcccagcggctgcttctgattgagagtcgaggtcggaggctttgggaggctgagaggctgctcggtttcacaactgctgagggagacttgggctccatctcaggtatgccccatgtcgccctcaacctccagccaccggtcctccgtgtcccccatggccaggcacggcttgcagacatctgtcgttggctcctctcagccgtcgtgggctgaccctggcacgtcctcctgtggctgagcccagtggggacagctgcttccttttattaccctagaactctcgtctttgatcaggccccctcccctatgccacacagtccctgtcactcgggtgagcccagtagtcatggggaaggcctgcgggttccaaacatccaaaggcttgcgtgcagcatgacagcttgaaaccgatgttttttaccttgatcagatttcagcttggcgggggctttgctcagctttcagtgaggcctgggccgatttcccagcatcccctcctgaggccagcctctgtttcctgtgattttctgcacaaagtgggagggaggagtcctaggaaatggggggccacctcgaagcctaggcctcctctggcttctctgtgccagtgcccccacgctttgtgtctgtgtccccagcccatgggactctgctattccctgagtgctgccgcatgcccagcccgcactgaggacgtggagccccgaggggcaggatggcctccatggtcacacgtaggaagtggcctccaccctccgatgatcctctccctcctccctttcagcgccctccccgggggtgtcctcagccctcctgcctgtgctttgtcccgtcttctgcaggcgcctgggacgtgctgacaggtcctctgccggctcctgccttgctatgcgcacgctggtcaccacagaggcctggcccttcttctgtagcagtcccacacccgcaacaggtgtggctgctgaccacctgctttctgcccctctggtcctgaggagggcgcagtgggcactcaggcgtggctgagcagatgtgtgttgccgggaggaggaaggactgctccagtcagggctgaatttcccacccggagcatttctgctgtatttggtgtagcgcctgctgcttaaagctctgattcccagttggcaccctttcccttctgcattgaaaaacatacggatgcatgtcttcttgcagtgaatgtgtattctcccagcctctcttctgggttggggctggaggtggagcggcacacaggagccgcagcgatggaggatgtgcgggtgcagcaccccgtacagcagggatgccaaacccgcgctgagtccctctcaacttctgctttgaagcccagtcacgccattgcctgggttttgctgggcggggctgcgtgtgatgttctcctctgtccctcccccagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacggtgaggccctccccgtcaaggctctgccaagaccctggccctgccctccgggatacgagcttggggctgcctccggcctcacaggagtaggggctctgaaaacctttgcttgcagggagattgccaagtctgtcttttaggcccaacaaggaaaactctgcagttccacccatcctgtcccaccaggtagtgtggcttgaaggcagactgtgagggtctatctcaccttcctgcattaggtcaggagtttcacagaaacctgaggcacattcaggggtgggctgcagaggtccatggctcacaccctggaaaatccgcccccaaaagacagtgctgtctccactgaccagtctgtgggatagtgcttaagcctgagtggtttctatcaacatgtagaatcaggaggtataaagagatttgctcaggcatcctgggccctctctgaccagcaggatcttcctttagatcttgacagtgaaacacatctcttctgtgccccctgtgagttttctttcattcattcattcattcattcattcattcattcattcattcgagacagagtcttgctctgtcacccaggctggagtgccctggtgtaatctcggctcactgcaacctctgcctccagggttcaatcgattctcctgcctcagcctcccgagtagctgggatgacaggtgcgcaccaccatgcctggctaatttttgtatttttagtagagacagggtttcaccatgttggccaggctggtctcgaactcctgacctcaggtgatccgcccgcctcagcctcccaaagtgctgggattacaggcatgagccaccgcgcccggcctgagttttccttttatgaaggacctgcttggttggttgcctgccacatgttgtcagcaccatgggcccaggactgctgaggagctgttgatgccctcgctctcccagagccaccggctctgttagataattcacatgcagtctggccactgtcctacgtcctcattcacaaagagcagacatttcgtagaagatgagggcctgggagtaacctccctgcatgtttttctataaaggcatagtggttaagtccttccagctcattgaccattggagaattttatggaggctgtagactaggggctggtaaactaagggcccaggggccaaatccagcctgccacctacttttgtaaataaagttttcttggtgcacagccatgcccattcattcatttgcacaatgtctgtggctgctttcatgccaaaagcaagagaactgagtggttatgctggagacctacggccttcaaagccccagacctcacgtctggcccttgacagacagagcttccccagccctgctgcgcatcctggcccagcatgtgctgtgtgtgtgatttcagcttgcaggagccgtggttaggaattgtccctgtgttggtccattttgcattgctatgaaggagcacctgaggccgggtagattatgaaggaaagaggtctgtctggctcatggttctgtaggcagcaccagtatggcacccgcatctgctcagcttctagtgaggtctcaggaagctttgactcatggtgaaagtcgaagcgggagcaggtgcatcacatggtgagagagggagcaacggagagagagagagagcgcctctccctcttgccctcaccttgagaggagatgccaggctcctttaagtaaccagctcccatgtgaactcacagtgagagcccatttgctactgcggagagggcaccaggcatctgctcccatgacccaaacactgcccaccaggccctacctccaaccttggggtcatattttattctgttctatgctatgctatgctatgccatgccatgccatgccatgctattcctattctattatttgagacagaatctcgctctgttgcccaggctggagtgcagtggcatgatcttggctcactgcaacctccacctcccaggttcaagcgattctcctgtatcagcctcccgagtagctgggattacaggcacacaccaccacacccggctaatttttgtattttcaatagagatggggtttcaccatgttggccaggctggtctcaaactcctggcctcaagtgatccacctacctcggcctcccaaagtgccatgattacagatgtgagtcactgcgcccagtgagggtcacatttccgttgagatttggaggggcagacgttggagccatctgagccccctcgtcccgctctagcttctcctcccgtgtgccccgcggtgctggtggcaggcccttacgccggttctggctgcatgctctgttccagaagctttcttccctgcttggttaccagaaaatcatcccatccattacaaggacagggtccccttatctcccattcccagggcaggacaccgggggcagggcaggtggggaactgagcaagttctctgggggcaggcgtggctatggctccctctgggtgggcgtctggggaggggtggaggcagccgtcagcgccctggcttgctcttcctccctggccagagactgtggccttgtgctgctcccgtgtgggctgcctgcacctccagtgggttgtgctccctcccctcccctcccctcaagctctgctgagcaccactgccttccacagcccccactctcgggaggcgaggctcctcgtggccattcctgtccttggcacccacccccccaccaacctggtagagccttgggcggggtctgttactccttgcatggcgtagacctccccacagtaggcacctgacacatacctcctggggggcaggcaggaggtgcgttgaggtctcagccctggcagtccctcccctgcgtggcataggcctcgccacagggtcatcgagggtgggtggagactgtactagaccactccccgctggtcctagaaagggtcccatctgtctgctctctgtttggagtccagaccttggttgctgtgccctgcatggtgggctggggggcaccctccagcctctctgagtgcatggcctctccttgcagccatctgcctgcccaaccagttccggtgtgcgagcggccagtgtgtcctcatcaaacagcagtgcgactccttccccgactgtatcgacggctccgacgagctcatgtgtggtgagccagcttctggcacggggaaggggcgtccgggctgggttcccccaggaacgtggagtttaggggaggagacgtgcctttccagcggggctgggggctgtgtgggagactcaggcggctgggaggctccttgcgggaggcagggaagcctttcccagggcagcggccaggaggacagactgtgagctgtgggctcggcggctacagagtctgcctcagtgggcggggctgatggtgtccaggtgcctgcagcacgcacccacccacgggaccttgctgagcagcgtctgtcaggcagcaagattacccgagggctgcagtggtcctgttccctggcagcttactgtctggctgaggaggagtgatgttcacatatgcacacatgtcatgtgcacacacatgtacatgacaacatcccacatgctcctcaaatagcatgacctgtacagtcacggatatagggcctaggggataggaggccaagacagtcagggaagactttccagaggcagtggctcctgaaaggctgtctgattcaggcaggaagggagctgagttcagataggaagtagcaatgagtcattgtgtctggggacatggccactccttcgctgcagagggacctgggctgagagctcctctcttatggctgcagtcgggagagaagtctgttggggggagaagggggcttcctcaagggactccctgtgccctttggcaccttcgtgccaggtcaggcttgaggcctgaaggcagtggtgggggccaccaagggtcgcctcctctgctgggcaagttcccagtctgacgggcctgtgccgtgggccccagctgtgggggcgctgttgatgcgcagccaggcctcgccgccagagcccgcacgcttccattccgctgacttcatcgacgccctcaggatcgctgggccggccctgtgggagagtgaatgtggcttttgccaaagttgagtctggagcctggaaacttccctatgggcagccttgatagtggagtggcccaaggagcccacccagccgaccctgcccctcccgtggctggtgggcggcaccaggggctgcctggctttgctcgttcaccaacatcacctgggctggccagggcgcgctcacttctgccaccaccgagggccctgggcgaaggagtgaataccaggctgccttggcagggatgtgttgagggctgtggggagtcggacagcggcgggggtcagaggaggaggagggtgcaccgtgcaggctgaagggccacgttaccctgaggttggccaggctccccaggcctagcctcccagctcccccactttctccccaccctccaccagtggcaaagccagccccttcagggcgcacggtgtctgcccccaaggagggcccattccgttggggttaatgttggccacctctttctgtttgtctctggcagaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggtaaggagcctgagatatggaatgatctggaggaggcaggagagtagtctgggcagctttggggagtggagcagggatgtgctaccccaggccctcttgcacatgtggcagacattgctaatcgatcacagcattcagcctttcccactgagcctgtgcttggcatcagaatccttcaacacagaggcctgcatggctgtagcaacccaccctttggcactgtaggtgtggagaaagctccttggacttgaccttcatattctagtaggacatgtgctgtgttgtccacaaatcctcatgtaccctagaaatgaatgtgggggcggctgggctctctccagagctgaaggaatcactctgtaccatacagcagctttgtcttgagtgcagctgggatttgtggctgagcagttacaattcctacgtggcccaggcaccaggaacgcaggctgtgtttgtagatggctgggcagccgcaccgcagagctgcaccatgctggtttgtatcacatgggtgaccatggtatgtctaagaaggtggagtccctgtgaggtctgcaggtgcccccacagctccaggccaccttgaggattgcctctgcctgcccagccctgagttccctctcccctgtcctgtcccactgtcaccccaagccggcctcattgggagcctgttggatggcagggtatagatgtaacctgattctctctggggagcggggttatctggcttctcaagagctcctaggagcccacagtggtggcaccatcacagtcgcagcagcccccagagaacgcggccctgtctgttcctggcgtgctctgtgctgccccgcctgggttccctgccccagtcgcaggccccttggaggaggtaccatgtgtctcccgtttcacagatgagccccggggagctcactctagtagtggccagagaggcctgcggctcagggagcggggcacatttccaacaggacacaccgccctggtctgagtctcgtgggtagtgggagcagaggagagcgccctatgtctgtggggcggcttggctgagcctggaagccacctgacctcccccgtcccttccctgccaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccggtgaggggcggggccggggaggggcggggcgggatggggctgtgggcccctcccaccgtcagtgctggccaccggaggcttcccgggttcctgggggctgtgccaccgcctctgaggcatgcttgctttcttcccttttcaaacccttctgcttccttctttaatgacattgttgattgtggataatctgaaaactacacaaaaatataaagagccaaaatctcacccaaatccacctcctagagtggctgttgggctccgtcagcatccaggcggccgtctgtgttccgcacggcccagcccatcgatagccgcctgcaccaggcctgtctgccctctgtgagcctccccacagggttccctccacaaacaccctgttctcccacccagggctggctgcttcctggaaaacagctggatggttttgtgcatgacagacaaacacagggtgattttcgtggctaaaatactccctggagcttttggcagggtgaggggctggctccagctgagccacgccttgagtgaaatgactgtgaggagaataaactgccgctgccctccaggatcactggggctggctggggagaacccccgtttctgggagcacagtcccaggatgccaaggcgagcttggtgccgagatgtgaactcctgagtgtaaacagcgggggctgacttgacatgctttgtatgcttttcatttgttcctgcagctgtatgcccctaaggtgagtccagcccccttctgcttcctctggggcctcgccagtgagccccaccttgctggggctggttcctcctgcccttctgggtatccctcacatctggggtcttgtcttcttgttttctttttcttttttttttgagacggagtttcacttttgttgcccaggcttcagtgcaatggtgtgatctctaggctcaccgcaacctctgcctcccaggttcaagcagttcccctgcctcagcctccctagtagctgggattacaggcatgtgccaccacgcccagctaattttgtatttttagtagagatggggtttctccatgttggtcaggctgatcttgaactccctacctcaggtgatccgcccaccttggcctcccaaagtgctgggattacaggcgtgagccaccgcacctggcctttttcttttcttttcttttcttttttctgagacagggtctcgctctgtcacccaggctggagtgcaatggtgtcatcatggctaactgcagcctctaccttctaggctcaagcaatcctcccatctcagcccctaagtagctaggactgcacgcatgcatccccatgcccagctaatatttacattttttgtagagatgaagtttcactatattgcccaggctggtctccaactcctggactcgagcgatcctcctgcctcggcctccccaggtgctgggattacaggcgtgagccaccgtgcctggcctggggtattgtcttcttatggcacctgactgtggtgggccctgggaaggaagtagcagaagagggttcttcttggtttcctggacagtaactgagtgttctggaggccccagggcctggctttgtttagggacaaagggaactggtaaccagaagccgagagtttaaacacccactgcccttcttccctgctcctgctgctgcaacccagcttaaccagccaggagtgctaggaacccaagcagggcccccgagcacacagcaggcagctcacgaattctcttttcctgttctcccttgggagctgggaggatcttaatcaggcaataagagatggcactgagcagccagctaattttttaaatcactttattgtttaaccatatgactcacccacttaaaaaagggtacagttcagtgggttttagtgtattcacagatgtgtgcaaccctcaccacagttaattttagaacattttcctgcccctaaaagaaactctgcatgaagccagctgtttttaaattagcaaagttattttgcatcctttaaatatatgttcatggtacaaaattcaaaagatacagaagagtctgcagtccaaagagactccgcccccatgacgccaagcaggcatccctgggaggcatggcctcctgcagtgtgtttcttctatgtccccccaggggtcatctgtacatatgcaagcatacaagagcgtggactttgttttccaagccagaagataattgtagatttatgtgcagttgtgagaaagagcacagacccatttatcctctgcctggtttcccccagtgctgcctgccatcttgcatgacttccattcctatcataagcaagacactgataacgattctttcaccttattcagattgacataagtgttttttgtttgttcttgagacaaacttcctctgtcacccagtgggagtgcagtggcacaatcacagctcactgcagcctcaaactcctgggctcaagcgattctcctgcctcagtcccctcaagtagctcagatggcaggtgtgcaccatcatgccaggctaatttttaaattttttgtggaggtgaggcctcactaaatttcctgggctagtcttgaactcctgagctaaagtgatcctcctgcctcagcctcccaaagtggtaggattacaggcatgagccactgcgcctgggctgacatatgtgttttcgtaagcccgaaagatagcatctgaagagtcaacattgagccttgccttttgctgctaacgatgtataaaagctgctgttctgagcatttcggaggctcccagctgccgtgtgcaccctgcctagagctctaccgtaacccatctccgggaggaggtgctattgttttcctcattttgcaacaaggaggctgaagaactgagcatgaaccactggcctgggtcgttcggttggtaggcagtggggccaggccatccaactcacaaccaccttctactctgcttcccccgcaccctgaagtttgttctgttttgaggacacagccgtcacattcttggtggctgaacagcactccttgtcaggcgtggctgggcccccactggagggcatcatggtcctctctcctgctgcggttgaaccttggctgtttcaaccactcctgccaagtggccctctgaaagggacagtccatcttttctcagcagagggccacactggcaaaacggtccctggcaccctttctctccacctgtctaatatagagtaaaaatggtatcatgttaagatcttcatttatatttattttatcatgaatgatgtaagcatcattttgtgtgtttaagaacctttgggcccagcgtgatggcttgcagctgtaatctcagcactttaggaggctgagatgagcggatcacttgaggccgggagtttgagaccagcctggccaacatggagaaaccccgtctctagtaaaaatttaaaaattagccgggtatggtgatcccagctacttgggagtctgaagcatgagaattgcttgaacatgggaggcggaggttgcagtgagccgagatcgcgccattgcactccagcctgggcgacagagcgagactctgtctcaaaaaaaaaaaaaaaaaagaaaagaaaagaaattatcaatctcctcttttatggcatatatatatatatatatatatatatatatatatatatatattttttttttttggttatgttcagaaaggccttccctgctctgatcataaaaaacaacttattttcacactctctctcttttttttttgagacagagttttgctcctgttgcccaggctggagtgcagtggcgcaatctcagctcactgtaacctccgcctcccgggttggagtgattctcctgccttaccttcccgagtagctgggattataggcatgcaccaccatgcctggctaattttgtacttttagtagagacgggggtttctccatgttggtcaggctggtctcgaactcgcgacctcaggtgatccacccacctcggcctcccaaagtgctgggattacagacgtgagccaccatgcccagcccacactctctttcttaacgtcctcctcctttcgttttacgttcacatctttaattcttctgggatgtaattagatttgatgagcaaggtgggcatccagcttgtttcttggctgatggcttatgggtggcgtgaattagtcggggtctatcaggaggcagaaactctatgagaatttgaacagagaaagttccgtctacaggcttattaccagggactggaatagcagaaattgaacagtgagatgtacagagaactctaagaatgcaggaataggccaggcatggtggctcacacctgtcatcccagcactttgggagaccaaggcgggtggatcacctgaggtcaggagttcgagaccagcctggccaacatagtgaaaccccatctctactaaaaatacaaaaaaattagctgggtgtggtggcgcatgcctgtaatcccagctactcgggaggctgaggcaggagaatcacttgaacctgggaggcagaggttgcagtgagccgagatcatgccactgtactccagcctgggtggaagagcggaactctgtctgaaaaaaaaaaaaaaaacaagaagttcaacttgaagggaaaaatgccgtattgtctttccctttgttatgtcaccagggcacagtccatcccaggctggcgctgatccacgggctggagaggggctgccccagaagaggacatgccaggaagggcttggctggtgttcaggagcccaggccaggtcaggtcaagaggtgttgaggctggacgggagaggccagctaggggctcatgtaggatatgaggggtcggcccatttcaacgtggaaactgagctcttctgcttctctttcttcttcactgcattaagattcaataccgcttgggaagcaggtatttcccttcctataaaggatggttgggagcctgagtgttgggagaaagtgtagccgctgagttactaacaactagggctgccgtcaagcctatggggaaagagagaagaggacatttggaaggagagagatcaagctgtggcaccctgggagaggaccacagaaaagaggccagtgagggggttccccggtggcatctgaaggtgtggcccaaccaggaggtccagaggctgccagccgagtggcccaggagagggaacctcacaggggctgagtgggacccaagccctatccaccgtcctaaccacccacatttctcgggaacaagacctcccacagtggcctccccggcagtggaaatagccaaactggcaacatggactttcttcaactgcccgggcgatgctgcctcagtgccccagggcaggcaggaagctcccacacccattctggaatgaggggttggaggaaggctgagctgagcaaaggacccatctctgctctggttggtggggagggagcccattatacaagagacccctcagggctcagtgaggggtgacagagacttggggagtagtggctgtcactgcagaggtgagagggtttggagagaaggtacatgcctttttggccacattgagtagcacctggtagccagttagtaacgtgtattggataaacaaaagattaaacggatgcaaaaaaaaatgttggctttgcttctttttacccaaacctcagttccctcaagtagattctgggaacaccccctacctggctggactgttgtgaagtttaaataagccaggttaacttcacctcctcctttaagacacagctcagacactgcctcctccaagaagccccctctggcttcctgtgtgaatatgacggccctctgggctctagggtatcttagaacaatgcttccttatggctttggaaccccgctgtctcctggattgggagcaaatgcaggggaggagccacacctgactaatctctgggtctcccagcacataagtggcataagggcagggctgtgcccgcttcaggcacttactgaaggatgtacttggcagagggtaggcagccggcggatgagcccctcactctccccagctgactgcgtgggcgggaaaggcgggttcaggagacccagcctccctgggctgtcaccacctctgcacatccagccccattgatcaagggttcaatttttggggtcctgttgggaggccaggagactctctccaggcacttcttccaggtctttgtgttagggtgtgtgtgtgtgtgtgtgtgtgtgtgtgtgtgtgttgtttgttttattttatttatttatttatttatttatttatttatttatttattttgagacgcagtctcgctctgttgcccaggttggagggtggtggcatgatctcggctcactgcaagctccgcctcccgggttcacgccattctcctgcctcactcttcctgagtagccggattacaggcgcacgcaccatgcctggctaattattttgtttttttagtagagacagggtttcgccacgttgcccaggctggtcttgaatccctggcctcaagcgatccgcccgcctcagcctcccaaagtgctgggattacaggcgtgagccaccgtgcccgcccagcctaggggtacatgaaacttttttttttttttttttgagacagagtttcactctgtcctcaggctggagtgcagtggcgtgatctcggcgtactgcaatctccgcctcccggttcaagcgattctcctgcctcagcctcccgagtagctgggattgcaggcacgcgccaccacacccagctaatttttgtatttttagtagagacgggctttcaccatgtgggacaggatggtctcgatctcctgacctcgtgatccgcccgcctcagcctccgaaagtgctgggattacaggcctgagccaccgtgcccagccatgatgttttgatacaggcatataacgtataataatcacatcagggtaaatgatgtaaccatcacatcaagcatttatcctttgtgttacaaaaaaaaatctaattatactttcctacttattcttttttttttttttttttgagacggagtctccctcagtcgcccaggctggagtgcagtggcatgatctcagttcactgcaagctctgcctcctagctctgcctcctgggttcatgccattctcctgtctcagcctcgcgagtagctgggactacaggcgcctgccaccgtgcccggctaatttttttttttgtatttttggtagagacagggtttcaccgtgttagccaggatggtctcgatctcctgacctcataatccgcccgtctcggcctcccaaagtgctgggattacaggcatgagccaccgcccccagcctatttattcttaaatgtacaataaattattgttgactccagtcaccctgctgtgctaccaaatacggatcttcttcattctatctaactgtatttctgtacctgttaaccatctctcctccacctcaccccccaaacccactacccttctcagcctctggtaaccatccttctactctctatctctatgagttcaattgtattaatttttagctccccggccgggcacggtggctcacgcctgtaatcccagcacttcaggaggctgaggcaggtggatcacgaggtcaggagtttgagaccagcctggccaacatggtggaaccccatctctactaaaaacacaaaaattagctgggcgtggtggtgggcgcttgtagtcccagctacttgggaggctgaggcaggagaatcgcttgaaactgggaggcagaggttgcagtgagccaagattgcgccactgcactccagtctgggtgacagagtaagattccatcccgaaaaaaaaaaagtttagctcccacaaataagtgagaacacgtgaagtttctctttctgtgcctcgcttgtttcacttaacataatgacctccagttccatccacgttgttgctttgttataaatgacaggatcttggtcaggcgcagtggctcatgcctgtaatcccagcactttgggaggctgaggtggactgatcatgaggtcaagagatcgagaccatcctggctaacacagtgaaaccccgtctctactaaaaatacaagaaattagccgggcgtggtggtgggcacccatttccgccccttctcgggacgctgatgcacgacatattacccatccccggaagactaatcctcccccactctatattgtacctcttcctttctcctccacgcgattccccgagtaacccgtcttccctccctcctcggattacgctcacctttccgcttcaatcacgttgctccgtccccttccccattcgtaccactcctcactttcgtcttcctacccccactatcccttttcgtcctctctattccttacttactcctcccccttctcttcatacttcattccctccgctcttcccactcgcgctcccactttcacctagttgccctcacctacgttgccatctcgccccttcttcagctctcggcctctcacccatctgtcctctctcttacctctctcctcatctcgctcagacatctctctagactatccctcactttaccttctcagtcgtcttcttcctatccttcgttctccatgatcttcacgtcgccatctcttttcgcccctttcatatgtctctcttcatgttctcactatcattctcatgatcactatcgttctcactacttatcactcccctctttcttcatcaattcctctccgtcattctcgtctctctcttacaaccgccttccttgtgctatctaactcaaccatgcctctcctactctctctctatcgcccctccatcgcttatgcatcctcttctattgcacacccgcccctccatcgcttatgcatcctcttctattgcacaccgcccctccatcgcttatgcatcctcttctattgcacatcctcttctattgcac

SEQ ID NO: 12 - DNA, 21 bp, Artificial Sequence
  Artificial sequence is a primer.
ctgagcggaattcgtgagacc

SEQ ID NO: 13 - DNA, 23 bp, Artificial Sequence
  Artificial sequence is a primer.
ttggtctcacgtattccgctcga

SEQ ID NO: 14 - DNA, 20 bp, Artificial Sequence
  Artificial sequence is a primer.
ctcgagaattctggatcctc

SEQ ID NO: 15 - DNA, 22 bp, Artificial Sequence
  Artificial sequence is a primer.
ttgaggatccagaattctcgag

SEQ ID NO: 16 - DNA, 21 bp, Artificial Sequence
  Artificial sequence is a primer.
tgtatgcgaattcgctgcgcg

SEQ ID NO: 17 - DNA, 23 bp, Artificial Sequence
  Artificial sequence is a primer.
ttcgcgcagcgaattcgcataca

SEQ ID NO: 18 - DNA, 21 bp, Artificial Sequence
  Artificial sequence is a primer.
gtccactgaattctcagtgag

SEQ ID NO: 19 - DNA, 23 bp, Artificial Sequence
  Artificial sequence is a primer.
ttgtcactgagaattcagtggac

SEQ ID NO: 20 - DNA, 21 bp, Artificial Sequence
  Artificial sequence is a primer.
gaatccgaattcctggtcagc

SEQ ID NO: 21 - DNA, 23 bp, Artificial Sequence
  Artificial sequence is a primer.
ttgctgaccaggaattcggattc

SEQ ID NO: 22 - DNA, 33 bp, Artificial Sequence
  Artificial sequence is a primer.
cuacuacuacuactgagcggaattcgtgagacc

SEQ ID NO: 23 - DNA, 32 bp, Artificial Sequence
  Artificial sequence is a primer.
cuacuacuacuactcgagaattctggatcctc

SEQ ID NO: 24 - DNA, 33 bp, Artificial Sequence
  Artificial sequence is a primer.
cuacuacuacuatgtatgcgaattcgctgcgcg

SEQ ID NO: 25 - DNA, 33 bp, Artificial Sequence
  Artificial sequence is a primer.
cuacuacuacuagtccactgaattctcagtgag

SEQ ID NO: 26 - DNA, 33 bp, Artificial Sequence
  Artificial sequence is a primer.
cuacuacuacuagaatccgaattcctggtcagc

SEQ ID NO: 27 - DNA, 45 bp, Artificial Sequence
  Artificial sequence is a primer.
aactggaagaattcgcggccgcaggaatttttttttttttttttt

SEQ ID NO: 28 - DNA, 13 bp, Artificial Sequence
  Artificial sequence is a primer.
aattcggcacgag

SEQ ID NO: 29 - DNA, 9 bp, Artificial Sequence
  Artificial sequence is a primer.
ctcgtgccg

SEQ ID NO: 30 - DNA, 14 bp, Artificial Sequence
  Artificial sequence is a primer.
gtacgacggccagt

SEQ ID NO: 31 - DNA, 16 bp, Artificial Sequence
  Artificial sequence is a primer.
aacagctatgaccatg

SEQ ID NO: 32 - DNA, 18 bp, Artificial Sequence
  Artificial sequence is a primer.
ccaagttctgagaagtcc

SEQ ID NO: 33 - DNA, 20 bp, Artificial Sequence
  Artificial sequence is a primer.
aatacctgaaaccatacctg

SEQ ID NO: 34 - DNA, 57 bp, Artificial Sequence
  Artificial sequence is a primer.
agctgctcgtagctgtctctccctggatcacgggtacatgtactggacagactgggt

SEQ ID NO: 35 - DNA, 56 bp, Artificial Sequence
  Artificial sequence is a primer.
tgagacgcccggattgagcgggcagggatagcttattccctgtgccgcattacggc

SEQ ID NO: 36 - DNA, 27 bp, Artificial Sequence
  Artificial sequence is a primer.
agctgctcgtagctgtctctccctgga

SEQ ID NO: 37 - DNA, 27 bp, Artificial Sequence
  Artificial sequence is a primer.
gccgtaatgcggcacagggaataagct

SEQ ID NO: 38 - DNA, 20 bp, Artificial Sequence
  Artificial sequence is a primer.
gagaggctatatccctgggc

SEQ ID NO: 39 - DNA, 20 bp, Artificial Sequence
  Artificial sequence is a primer.
acagcacgtgtttaaagggg

SEQ ID NO: 40 - DNA, 163 bp, Homo sapiens
actaaagcgccgccgccgcgccatggagcccgagtgagctcggcgcgggcccgtccggccgccggacaacatggaggcagctccgcccgggccgccgtggccgctgctgctgctgctgctgctgctgctggcgctgtgcggctgcccggcccccgccgcggcc

SEQ ID NO: 41 - DNA, 419 bp, Homo sapiens
gccccacagcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtaaaccctgctg

SEQ ID NO: 42 - DNA, 221 bp, Homo sapiens
ccccgtcacaggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggtaggtacccac

SEQ ID NO: 43 - DNA, 221 bp, Homo sapiens
tccctgactgcaggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctatactcacccatggacatccaggtgctgagccaggagcggcagcctttttgtgagtgccgg

SEQ ID NO: 44 - DNA, 156 bp, Homo sapiens
tttctcagtccacactcgctgtgaggaggacaatggcggctggtcccacctgtgcctgctgtccccaagcgagcctttttacacatgcgcctgccccacgggtgtgcagatgcaggacaacggcaggacgtgtaaggcaggtgaggcggtgggacg

SEQ ID NO: 45 - DNA, 416 bp, Homo sapiens
ctccacaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatggggtaagacgggc

SEQ ID NO: 46 - DNA, 198 bp, Homo sapiens
ttcttctccagcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgaggctcctgtgg

SEQ ID NO: 47 - DNA, 244 bp, Homo sapiens
ccgtcctgcaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggtgagtccggggggtc

SEQ ID NO: 48 - DNA, 313 bp, Homo sapiens
gttcgcttccaggaaccaacccgtgtgcggacaggaacggggggtgcagccacctgtgcttctgcacaccccacgcaacccggtgtggctgccccatcggcctggagctgctgagtgacatgaagacctgcatcgtgcctgaggcctttttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaaggtagcgtgggc

SEQ ID NO: 49 - DNA, 255 bp, Homo sapiens
cctgctgccagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaaggggtaagtgtttgcctgtc

SEQ ID NO: 50 - DNA, 210 bp, Homo sapiens
gtgccttccagctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtgagggccgggct

SEQ ID NO: 51 - DNA, 352 bp, Homo sapiens
gtgttcatgcaggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagccgtaagtgcctcatggt

SEQ ID NO: 52 - DNA, 225 bp, Homo sapiens
gcctcctctacgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccaggcaggtgccctgtgg

SEQ ID NO: 53 - DNA, 235 bp, Homo sapiens
ctttgtcttacagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtaggaggccaac

SEQ ID NO: 54 - DNA, 218 bp, Homo sapiens
ccaccctcccgcaggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggtacgcgccccgg

SEQ ID NO: 55 - DNA, 234 bp, Homo sapiens
ggctgcttgcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctgtacgtgggggc

SEQ ID NO: 56 - DNA, 157 bp, Homo sapiens
ttgtctttgcagcagcccacccatgtgcccgtgacaatggtggctgctcccacatctgtattgccaagggtgatgggacaccacggtgctcatgcccagtccacctcgtgctcctgcagaacctgctgacctgtggaggtaggtgtgacctaggtgc

SEQ ID NO: 57 - DNA, 272 bp, Homo sapiens
gttctcctctgtccctcccccagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggtggactgtgacggtgaggccctcc

SEQ ID NO: 58 - DNA, 134 bp, Homo sapiens
tctccttgcagccatctgcctgcccaaccagttccggtgtgcgagcggccagtgtgtcctcatcaaacagcagtgcgactccttccccgactgtatcgacggctccgacgagctcatgtgtggtgagccagctt

SEQ ID NO: 59 - DNA, 274 bp, Homo sapiens
gtttgtctctggcagaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggtaaggagcctgagatatggaa

SEQ ID NO: 60 - DNA, 164 bp, Homo sapiens
cttccctgccaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccggtgaggggcggg

SEQ ID NO: 61 - DNA, 130 bp, Homo sapiens
ttggctctcctcagatcctgaacccgccgccctccccggccacggacccctccctgtacaacatggacatgttctactcttcaaacattccggccactgcgagaccgtacaggtaggacatcccctgcag

SEQ ID NO: 62 - DNA, 496 bp, Homo sapiens
tcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaaca

SEQ ID NO: 63 - DNA, 22 bp, Artificial Sequence
  Artificial Sequence is a primer.
ttttgggtacacaattcagtcg

SEQ ID NO: 64 - DNA, 20 bp, Artificial Sequence
  Artificial Sequence is a primer.
aaaactgtgggtgcttctgg

SEQ ID NO: 65 - DNA, 21 bp, Artificial Sequence
  Artificial Sequence is a primer.
gtgattgagccaatcctgaga

SEQ ID NO: 66 - DNA, 21 bp, Artificial Sequence
  Artificial Sequence is a primer.
tgagccaaataaaccccttct

SEQ ID NO: 67 - DNA, 20 bp, Homo sapiens
ctggactacgtggccttctc

SEQ ID NO: 68 - DNA, 19 bp, Homo sapiens
ttcagaagcacttggctgg

SEQ ID NO: 69 - DNA, 20 bp, Homo sapiens
ctcagtgccatgaagatgga

SEQ ID NO: 70 - DNA, 21 bp, Homo sapiens
caagatcactcgatctccagg

SEQ ID NO: 71 - DNA, 20 bp, Homo sapiens
gtttcaggagactcagagtc

SEQ ID NO: 72 - DNA, 20 bp, Homo sapiens
ttctgcaggttgctgttgag

SEQ ID NO: 73 - DNA, 20 bp, Homo sapiens
ttattgtgatttcccgtggc

SEQ ID NO: 74 - DNA, 21 bp, Homo sapiens
gccctctgtcctgacttcagg

SEQ ID NO: 75 - DNA, 20 bp, Homo sapiens
gagaaagaaataaggggacc

SEQ ID NO: 76 - DNA, 20 bp, Homo sapiens
tgctttgtaaagcactgaga

SEQ ID NO: 77 - DNA, 24 bp, Homo sapiens
gaagtacgggcagttcagtggcct

SEQ ID NO: 78 - DNA, 25 bp, Homo sapiens
atacaccaaggtccatgttccccgt

SEQ ID NO: 79 - DNA, 25 bp, Homo sapiens
agcctgggccacagcgtgagactac

SEQ ID NO: 80 - DNA, 25 bp, Homo sapiens
tcccggagcttgcacacccgcttca

SEQ ID NO: 81 - DNA, 20 bp, Homo sapiens
catgtgcccacctcattcat

SEQ ID NO: 82 - DNA, 20 bp, Homo sapiens
caagattctgtagcttctgg

SEQ ID NO: 83 - DNA, 20 bp, Homo sapiens
cagagaagtcaagggacttg

SEQ ID NO: 84 - DNA, 20 bp, Homo sapiens
atcctctcacatcccacact

SEQ ID NO: 85 - DNA, 20 bp, Homo sapiens
caaggctaaaagacgaaaaa

SEQ ID NO: 86 - DNA, 20 bp, Homo sapiens
tcaggagcatttcatctttt

SEQ ID NO: 87 - DNA, 19 bp, Homo sapiens
aagtcgaggctgcaaggag

SEQ ID NO: 88 - DNA, 20 bp, Homo sapiens
gccctgtgttcctttcagta

SEQ ID NO: 89 - DNA, 19 bp, Homo sapiens
aaggtgtgaggatcactgg

SEQ ID NO: 90 - DNA, 17 bp, Homo sapiens
agctcatgggggctatt

SEQ ID NO: 91 - DNA, 20 bp, Homo sapiens
gcttctccgagtgtatcaac

SEQ ID NO: 92 - DNA, 20 bp, Homo sapiens
atggcagaggacttagaaca

SEQ ID NO: 93 - DNA, 24 bp, Homo sapiens
gatcagcgaacttcctctcggctc

SEQ ID NO: 94 - DNA, 24 bp, Homo sapiens
tccacattgaggactgtgggaacg

SEQ ID NO: 95 - DNA, 20 bp, Homo sapiens
gctaatcacagtctaaccga

SEQ ID NO: 96 - DNA, 19 bp, Homo sapiens
ttgcactgtcttggatgca

SEQ ID NO: 97 - DNA, 25 bp, Homo sapiens
gcacagctgtagtggggttctaggc

SEQ ID NO: 98 - DNA, 25 bp, Homo sapiens
caggcgcaaaggacatgcacacggc

SEQ ID NO: 99 - DNA, 25 bp, Homo sapiens
caccgatgagtgcacgttcaaggag

SEQ ID NO: 100 - DNA, 25 bp, Homo sapiens
cagacagagatgctccacgccatac

SEQ ID NO: 101 - DNA, 19 bp, Homo sapiens
tttctgggtgtgtctgaat

SEQ ID NO: 102 - DNA, 20 bp, Homo sapiens
acacagttgctctaaagggt

SEQ ID NO: 103 - DNA, 20 bp, Homo sapiens
catttgggaaatccagaaga

SEQ ID NO: 104 - DNA, 25 bp, Homo sapiens
taggtgtcttattttttgttgcttc

SEQ ID NO: 105 - DNA, 25 bp, Homo sapiens
gacataccatgaacactataagagg

SEQ ID NO: 106 - DNA, 20 bp, Homo sapiens
caacccataccagggataag

SEQ ID NO: 107 - DNA, 21 bp, Homo sapiens
gaacaagaggggtaagttggc

SEQ ID NO: 108 - DNA, 22 bp, Homo sapiens
tgaggacacagatactgatggg

SEQ ID NO: 109 - DNA, 25 bp, Homo sapiens
gaagtgttccctcttaaattctttg

SEQ ID NO: 110 - DNA, 25 bp, Homo sapiens
gaactatattgtagttagtgaggag

SEQ ID NO: 111 - DNA, 18 bp, Homo sapiens
cctgtaacccccagtccc

SEQ ID NO: 112 - DNA, 22 bp, Homo sapiens
tcttgcttcctaagtttctcgg

SEQ ID NO: 113 - DNA, 21 bp, Homo sapiens
actccatccacctcatcactg

SEQ ID NO: 114 - DNA, 20 bp, Homo sapiens
tgctgtttgcctcatctgac

SEQ ID NO: 115 - DNA, 20 bp, Homo sapiens
gtggacaggcatagctgagg

SEQ ID NO: 116 - DNA, 21 bp, Homo sapiens
tgttcactcttctgcctgcag

SEQ ID NO: 117 - DNA, 20 bp, Homo sapiens
agctggactctcacagaatg

SEQ ID NO: 118 - DNA, 20 bp, Homo sapiens
caagaggctggtagaaggtg

SEQ ID NO: 119 - DNA, 24 bp, Homo sapiens
gactccagtctgggcaataaaagc

SEQ ID NO: 120 - DNA, 22 bp, Homo sapiens
ggtggcagcatgacctctaaag

SEQ ID NO: 121 - DNA, 16 bp, Homo sapiens
caggcccagtctcttg

SEQ ID NO: 122 - DNA, 18 bp, Homo sapiens
cgtgtccagatgaaagtg

SEQ ID NO: 123 - DNA, 18 bp, Homo sapiens
acctcacggtgtaatccc

SEQ ID NO: 124 - DNA, 18 bp, Homo sapiens
cttgaagcccatctttgc

SEQ ID NO: 125 - DNA, 23 bp, Homo sapiens
tatttgcaaagcttgagacttct

SEQ ID NO: 126 - DNA, 20 bp, Homo sapiens
aatcactgtgctttgttgcc

SEQ ID NO: 127 - DNA, 20 bp, Homo sapiens
actttattgtcagcgtgggc

SEQ ID NO: 128 - DNA, 18 bp, Homo sapiens
actccctcgatggcttcc

SEQ ID NO: 129 - DNA, 18 bp, Homo sapiens
gagcaggggagagaaggc

SEQ ID NO: 130 - DNA, 20 bp, Homo sapiens
cccactggcttgttttattg

SEQ ID NO: 131 - DNA, 25 bp, Homo sapiens
agccactttattgttattttgatgc

SEQ ID NO: 132 - DNA, 25 bp, Homo sapiens
aagagtgaacaaaagcaaacatacc

SEQ ID NO: 133 - DNA, 18 bp, Homo sapiens
gtggagtgtgggattggg

SEQ ID NO: 134 - DNA, 25 bp, Homo sapiens
tactgttcttgataagtatgtcggc

SEQ ID NO: 135 - DNA, 25 bp, Homo sapiens
atgcttttgcatgattctaattatt

SEQ ID NO: 136 - DNA, 21 bp, Homo sapiens
tcccccaaaagaatgtaaagg

SEQ ID NO: 137 - DNA, 20 bp, Homo sapiens
ctggtcttccttgtgtgctg

SEQ ID NO: 138 - DNA, 18 bp, Homo sapiens
atcacccaggccagggat

SEQ ID NO: 139 - DNA, 24 bp, Homo sapiens
tcagaagcagaactgtttttaaca

SEQ ID NO: 140 - DNA, 22 bp, Homo sapiens
cctgcttgaaagttctagagcc

SEQ ID NO: 141 - DNA, 21 bp, Homo sapiens
caagcccgggttttattgaaa

SEQ ID NO: 142 - DNA, 18 bp, Homo sapiens
gatgccaggaccatggac

SEQ ID NO: 143 - DNA, 24 bp, Homo sapiens
gcatatagaaacaatttattgccg

SEQ ID NO: 144 - DNA, 20 bp, Homo sapiens
ctctgaagcagggaccagag

SEQ ID NO: 145 - DNA, 19 bp, Homo sapiens
ctaccacaccacaccaggc

SEQ ID NO: 146 - DNA, 18 bp, Homo sapiens
caagcgaaagctgccttc

SEQ ID NO: 147 - DNA, 23 bp, Homo sapiens
gttgtcttgacttcaggtctgtc

SEQ ID NO: 148 - DNA, 24 bp, Homo sapiens
ttttccttcaacaatcactactcc

SEQ ID NO: 149 - DNA, 20 bp, Homo sapiens
gcgtggggatatagaggtca

SEQ ID NO: 150 - DNA, 20 bp, Homo sapiens
tacgtggccaagaagctagg

SEQ ID NO: 151 - DNA, 24 bp, Homo sapiens
taatatatccccagtctaaggcat

SEQ ID NO: 152 - DNA, 18 bp, Homo sapiens
agcttgcagatggagccc

SEQ ID NO: 153 - DNA, 25 bp, Homo sapiens
tggttttaaacctttaatgagaaaa

SEQ ID NO: 154 - DNA, 23 bp, Homo sapiens
tgttgatctataccctgtttccg

SEQ ID NO: 155 - DNA, 25 bp, Homo sapiens
aattatttaaaagagaggaaaggca

SEQ ID NO: 156 - DNA, 20 bp, Homo sapiens
tggctgtgaacttcctctga

SEQ ID NO: 157 - DNA, 25 bp, Homo sapiens
ggttacagaaaaacatttgagagat

SEQ ID NO: 158 - DNA, 22 bp, Homo sapiens
tgagctttagttcccttctctg

SEQ ID NO: 159 - DNA, 23 bp, Homo sapiens
ttgaaaaaccatttatttcaccg

SEQ ID NO: 160 - DNA, 18 bp, Homo sapiens
tctgcggctgttggattt

SEQ ID NO: 161 - DNA, 23 bp, Homo sapiens
ttgaaaaaccatttatttcaccg

SEQ ID NO: 162 - DNA, 20 bp, Homo sapiens
tgttctcttctcccagcagg

SEQ ID NO: 163 - DNA, 23 bp, Homo sapiens
ctttattgaaaacattgagtgca

SEQ ID NO: 164 - DNA, 20 bp, Homo sapiens
ttgtcaaattccccccaaaa

SEQ ID NO: 165 - DNA, 16 bp, Homo sapiens
  misc_feature 12: n = A,T,C or G
aaaccacgaccnccaa

SEQ ID NO: 166 - DNA, 20 bp, Homo sapiens
ccctggaaaggtaagatgct

SEQ ID NO: 167 - DNA, 23 bp, Homo sapiens
cttttggtagagacaaggtctca

SEQ ID NO: 168 - DNA, 25 bp, Homo sapiens
tatctgtctgtagtgcttcaaatgt

SEQ ID NO: 169 - DNA, 19 bp, Homo sapiens
gacgaaggtgattcagggc

SEQ ID NO: 170 - DNA, 19 bp, Homo sapiens
actgaagaactcttgtcct

SEQ ID NO: 171 - DNA, 25 bp, Homo sapiens
cagataaaagagtcactatggctca

SEQ ID NO: 172 - DNA, 20 bp, Homo sapiens
cacttctcccactttgtccc

SEQ ID NO: 173 - DNA, 25 bp, Homo sapiens
ttattgataagcattagtgaacccc

SEQ ID NO: 174 - DNA, 20 bp, Homo sapiens
tggcaagttaggcacagtca

SEQ ID NO: 175 - DNA, 21 bp, Homo sapiens
ctatgcccagagatgaacagg

SEQ ID NO: 176 - DNA, 20 bp, Homo sapiens
tccactaagggctatgtcgc

SEQ ID NO: 177 - DNA, 24 bp, Homo sapiens
gccagctttattgagtaaacttcc

SEQ ID NO: 178 - DNA, 22 bp, Homo sapiens
cactggagactacaagtggtgg

SEQ ID NO: 179 - DNA, 20 bp, Homo sapiens
catcccaaccatcactcagt

SEQ ID NO: 180 - DNA, 22 bp, Homo sapiens
ggggactagcttacagatttga

SEQ ID NO: 181 - DNA, 23 bp, Homo sapiens
agactacattttggaaccagtgg

SEQ ID NO: 182 - DNA, 23 bp, Homo sapiens
tgaaaggatatttatagcctgga

SEQ ID NO: 183 - DNA, 20 bp, Homo sapiens
gaaggttttgtccctcgatc

SEQ ID NO: 184 - DNA, 20 bp, Homo sapiens
tgagggttgggaagatcata

SEQ ID NO: 185 - DNA, 18 bp, Homo sapiens
ccttcatagccacacccg

SEQ ID NO: 186 - DNA, 21 bp, Homo sapiens
cagctaactgttgacatgcca

SEQ ID NO: 187 - DNA, 25 bp, Homo sapiens
tctttactgtgcttacaactttcct

SEQ ID NO: 188 - DNA, 20 bp, Homo sapiens
caacagtgcagtcggtatcg

SEQ ID NO: 189 - DNA, 18 bp, Homo sapiens
agatcagcaagcagatag

SEQ ID NO: 190 - DNA, 18 bp, Homo sapiens
cattccacatggatagac

SEQ ID NO: 191 - DNA, 24 bp, Homo sapiens
catacctatgaggtgtgctacagg

SEQ ID NO: 192 - DNA, 21 bp, Homo sapiens
gcattttctcatcatccttgc

SEQ ID NO: 193 - DNA, 20 bp, Homo sapiens
ttacagccaccaaggtttcc

SEQ ID NO: 194 - DNA, 20 bp, Homo sapiens
aggtgtgtgtgccaggttga

SEQ ID NO: 195 - DNA, 25 bp, Homo sapiens
cactgttatctcattaactgtgagg

SEQ ID NO: 196 - DNA, 21 bp, Homo sapiens
tttgattttgtgtctcccaaa

SEQ ID NO: 197 - DNA, 20 bp, Homo sapiens
ccccactcccacttttattt

SEQ ID NO: 198 - DNA, 24 bp, Homo sapiens
ccagtcacctttactagtcctttg

SEQ ID NO: 199 - DNA, 20 bp, Homo sapiens
aggacacagcctgcatctag

SEQ ID NO: 200 - DNA, 20 bp, Homo sapiens
accaggcattgcactaaaag

SEQ ID NO: 201 - DNA, 22 bp, Homo sapiens
gatgggtcacactaacctgtca

SEQ ID NO: 202 - DNA, 24 bp, Homo sapiens
acatttatatttggacatgcaacc

SEQ ID NO: 203 - DNA, 22 bp, Homo sapiens
agcatctttaatgtgtcaggca

SEQ ID NO: 204 - DNA, 18 bp, Homo sapiens
atgtgctgggctggaaag

SEQ ID NO: 205 - DNA, 20 bp, Homo sapiens
tcacattcaaaaatcggcaa

SEQ ID NO: 206 - DNA, 18 bp, Homo sapiens
ctgcctgtgtggtgtcgc

SEQ ID NO: 207 - DNA, 25 bp, Homo sapiens
tgttttatttctcagtacaaagcca

SEQ ID NO: 208 - DNA, 19 bp, Homo sapiens
gacctcctgtgacaccacg

SEQ ID NO: 209 - DNA, 25 bp, Homo sapiens
ccaccaaattatttatagttctgcg

SEQ ID NO: 210 - DNA, 23 bp, Homo sapiens
gtaagattctccactgttgcacc

SEQ ID NO: 211 - DNA, 20 bp, Homo sapiens
cctataatgggctggaccaa

SEQ ID NO: 212 - DNA, 21 bp, Homo sapiens
actcctcatgtgaagtcaccg

SEQ ID NO: 213 - DNA, 20 bp, Homo sapiens
cagtgtgcacgttttcattt

SEQ ID NO: 214 - DNA, 20 bp, Homo sapiens
cagcatcttcagcacttacc

SEQ ID NO: 215 - DNA, 25 bp, Homo sapiens
ctgcatttattatgagaatcaacag

SEQ ID NO: 216 - DNA, 20 bp, Homo sapiens
tgctgctgggagtcagagtc

SEQ ID NO: 217 - DNA, 23 bp, Homo sapiens
cagggcactgagatacacttacc

SEQ ID NO: 218 - DNA, 21 bp, Homo sapiens
aaggatcaagccaggcatttg

SEQ ID NO: 219 - DNA, 20 bp, Homo sapiens
acacatctcttctgtgcccc

SEQ ID NO: 220 - DNA, 18 bp, Homo sapiens
tgaaccctggaggcagag

SEQ ID NO: 221 - DNA, 19 bp, Homo sapiens
cattccccagtttgcagac

SEQ ID NO: 222 - DNA, 19 bp, Homo sapiens
gtgctgggattacaggtgt

SEQ ID NO: 223 - DNA, 20 bp, Homo sapiens
gcagagaagtcctgttagcc

SEQ ID NO: 224 - DNA, 20 bp, Homo sapiens
ccatgctagagaagcacaac

SEQ ID NO: 225 - DNA, 20 bp, Homo sapiens
agtgtggggcaggacctctg

SEQ ID NO: 226 - DNA, 21 bp, Homo sapiens
cagacagatagccctgggttc

SEQ ID NO: 227 - DNA, 20 bp, Homo sapiens
tccctcatccccttgtctgt

SEQ ID NO: 228 - DNA, 19 bp, Homo sapiens
agcccccctggggataatc

SEQ ID NO: 229 - DNA, 19 bp, Homo sapiens
gatgcttacctaccacggc

SEQ ID NO: 230 - DNA, 21 bp, Homo sapiens
aggattcctatctgggctatg

SEQ ID NO: 231 - DNA, 20 bp, Homo sapiens
tggcagaccatgctccgcct

SEQ ID NO: 232 - DNA, 20 bp, Homo sapiens
gagaaggccgggaggctctg

SEQ ID NO: 233 - DNA, 25 bp, Homo sapiens
ctccatcacaaccagatttgaggct

SEQ ID NO: 234 - DNA, 22 bp, Homo sapiens
gggtgtgagctgctgctgaagg

SEQ ID NO: 235 - DNA, 25 bp, Homo sapiens
agtgggaaacctcaggtagctcccg

SEQ ID NO: 236 - DNA, 25 bp, Homo sapiens
cagtttggctcagacatatgggggc

SEQ ID NO: 237 - DNA, 20 bp, Homo sapiens
cattagtagtggggggacag

SEQ ID NO: 238 - DNA, 21 bp, Homo sapiens
caaagcgacagtgagttaggg

SEQ ID NO: 239 - DNA, 20 bp, Homo sapiens
ggagtagaccatgattactg

SEQ ID NO: 240 - DNA, 19 bp, Homo sapiens
catggtctatttattctcg

SEQ ID NO: 241 - DNA, 22 bp, Homo sapiens
cgccctggatcctcacactaca

SEQ ID NO: 242 - DNA, 21 bp, Homo sapiens
gggcatcaggggatgggtaga

SEQ ID NO: 243 - DNA, 23 bp, Homo sapiens
gctcctatctgtgttttgaatgg

SEQ ID NO: 244 - DNA, 22 bp, Homo sapiens
ccgtggcatagataagtaaacg

SEQ ID NO: 245 - DNA, 22 bp, Homo sapiens
cttggagcgctatgaggagggc

SEQ ID NO: 246 - DNA, 23 bp, Homo sapiens
atggcaactgaccttccgtcctg

SEQ ID NO: 247 - DNA, 16 bp, Homo sapiens
ttggagtcacaggggc

SEQ ID NO: 248 - DNA, 17 bp, Homo sapiens
cagcactatccttgggg

SEQ ID NO: 249 - DNA, 21 bp, Homo sapiens
aacaaagctgcttagcacctg

SEQ ID NO: 250 - DNA, 20 bp, Homo sapiens
gatgaggaccaactggtgac

SEQ ID NO: 251 - DNA, 20 bp, Homo sapiens
ttttccaataatgtgacttc

SEQ ID NO: 252 - DNA, 20 bp, Homo sapiens
caatcccaaccgtaacaggc

SEQ ID NO: 253 - DNA, 19 bp, Homo sapiens
cttgatctcgcccaggaac

SEQ ID NO: 254 - DNA, 20 bp, Homo sapiens
gctcgctgaaggatgaagac

SEQ ID NO: 255 - DNA, 17 bp, Homo sapiens
gaatcgcttgaacccag

SEQ ID NO: 256 - DNA, 17 bp, Homo sapiens
ccaggtggtcttaacgg

SEQ ID NO: 257 - DNA, 21 bp, Homo sapiens
  misc_feature 8: n = A,T,C or G
gaacgttnttcatgtaggcgt

SEQ ID NO: 258 - DNA, 16 bp, Homo sapiens
taatggtcgctgtccc

SEQ ID NO: 259 - DNA, 22 bp, Homo sapiens
agggaaaatggtatgtggggag

SEQ ID NO: 260 - DNA, 18 bp, Homo sapiens
gcagtgtgtgaaggcagg

SEQ ID NO: 261 - DNA, 24 bp, Homo sapiens
agtggacaaaatgaggaaaacagg

SEQ ID NO: 262 - DNA, 23 bp, Homo sapiens
ccaacacagtttgctcacatgcc

SEQ ID NO: 263 - DNA, 20 bp, Homo sapiens
tgacatctttgcattatggc

SEQ ID NO: 264 - DNA, 20 bp, Homo sapiens
agttatcccacctgataccg

SEQ ID NO: 265 - DNA, 20 bp, Homo sapiens
agctcttgcttctcagtcca

SEQ ID NO: 266 - DNA, 24 bp, Homo sapiens
caaaagttgtttctgtgtttgttc

SEQ ID NO: 267 - DNA, 22 bp, Homo sapiens
gcctctcaaagtagttggaacc

SEQ ID NO: 268 - DNA, 23 bp, Homo sapiens
tgtgtatccatagtgcaaaacag

SEQ ID NO: 269 - DNA, 19 bp, Homo sapiens
ctcaaggccaggcatcact

SEQ ID NO: 270 - DNA, 19 bp, Homo sapiens
ggactcttccatgccagtg

SEQ ID NO: 271 - DNA, 19 bp, Homo sapiens
aatgatgatctcaactctg

SEQ ID NO: 272 - DNA, 19 bp, Homo sapiens
actgaagaactcttgtcct

SEQ ID NO: 273 - DNA, 23 bp, Homo sapiens
gacatctgttagtctcataattc

SEQ ID NO: 274 - DNA, 18 bp, Homo sapiens
ggtaacagtgtcttgctt

SEQ ID NO: 275 - DNA, 21 bp, Homo sapiens
ctatgtacaaaacaggaagag

SEQ ID NO: 276 - DNA, 19 bp, Homo sapiens
atcctagtttcctctcctt

SEQ ID NO: 277 - DNA, 23 bp, Homo sapiens
gtaaatgagaaacagacaaatga

SEQ ID NO: 278 - DNA, 23 bp, Homo sapiens
ctattggatgtgatatgttatgg

SEQ ID NO: 279 - DNA, 22 bp, Homo sapiens
aagtagaaacaaaatgagggac

SEQ ID NO: 280 - DNA, 18 bp, Homo sapiens
cctaccccaaggtaacag

SEQ ID NO: 281 - DNA, 22 bp, Homo sapiens
acttcctataaatggaggtgag

SEQ ID NO: 282 - DNA, 18 bp, Homo sapiens
gaggagcttcaagaggaa

SEQ ID NO: 283 - DNA, 23 bp, Homo sapiens
catactcctagactcaaggaatc

SEQ ID NO: 284 - DNA, 23 bp, Homo sapiens
gaatgatgtacatgaattctttg

SEQ ID NO: 285 - DNA, 20 bp, Homo sapiens
gtgttgaggagaaaagcact

SEQ ID NO: 286 - DNA, 19 bp, Homo sapiens
ctcccagtagtcacattcc

SEQ ID NO: 287 - DNA, 23 bp, Homo sapiens
caagttacaaataacttaagccg

SEQ ID NO: 288 - DNA, 23 bp, Homo sapiens
caagaccctatctctacaaaaac

SEQ ID NO: 289 - DNA, 24 bp, Homo sapiens
tttattagaagtgactcttggccc

SEQ ID NO: 290 - DNA, 20 bp, Homo sapiens
gactacctgccctcagcttg

SEQ ID NO: 291 - DNA, 20 bp, Homo sapiens
ttctcatgtacaaagcggtc

SEQ ID NO: 292 - DNA, 20 bp, Homo sapiens
ccactggcttctctcttttt

SEQ ID NO: 293 - DNA, 18 bp, Homo sapiens
caccagaaggttggggtg

SEQ ID NO: 294 - DNA, 21 bp, Homo sapiens
actattacgacatgaacgcgg

SEQ ID NO: 295 - DNA, 18 bp, Homo sapiens
ctcatgctggatgacccc

SEQ ID NO: 296 - DNA, 24 bp, Homo sapiens
ttgcctttcttgaaacttaattcc

SEQ ID NO: 297 - DNA, 19 bp, Homo sapiens
tcacagccttcagtcaggg

SEQ ID NO: 298 - DNA, 18 bp, Homo sapiens
acatgctgtggcaccatg

SEQ ID NO: 299 - DNA, 18 bp, Homo sapiens
cctgagctactgccacag

SEQ ID NO: 300 - DNA, 20 bp, Homo sapiens
ccctgacttggacagtgtcc

SEQ ID NO: 301 - DNA, 18 bp, Homo sapiens
tcagagtcactcctgccc

SEQ ID NO: 302 - DNA, 22 bp, Homo sapiens
caaattcaagctcatccagacc

SEQ ID NO: 303 - DNA, 18 bp, Homo sapiens
cggcatttcatccaggac

SEQ ID NO: 304 - DNA, 20 bp, Homo sapiens
ggtgtaggaggtgcgacaat

SEQ ID NO: 305 - DNA, 20 bp, Homo sapiens
ttccatttattgagcacctg

SEQ ID NO: 306 - DNA, 20 bp, Homo sapiens
cttaagccactgtgttttgg

SEQ ID NO: 307 - DNA, 20 bp, Homo sapiens
cctcctacacctgcaaaagc

SEQ ID NO: 308 - DNA, 19 bp, Homo sapiens
tggaagaaccccagaggac

SEQ ID NO: 309 - DNA, 23 bp, Homo sapiens
aaagcacaaaagtaacagcaaca

SEQ ID NO: 310 - DNA, 20 bp, Homo sapiens
gtgtgtgggccacaatattg

SEQ ID NO: 311 - DNA, 20 bp, Homo sapiens
agagcacctttcctcagcac

SEQ ID NO: 312 - DNA, 20 bp, Homo sapiens
agaatctcatcacaggggcg

SEQ ID NO: 313 - DNA, 25 bp, Homo sapiens
aaaaaggacagtgtctaaaatttga

SEQ ID NO: 314 - DNA, 25 bp, Homo sapiens
aattgtttttgtttgttttttgagt

SEQ ID NO: 315 - DNA, 22 bp, Homo sapiens
gatttagggagtacaagtgcgg

SEQ ID NO: 316 - DNA, 25 bp, Homo sapiens
ggggacaaattatactttattcagg

SEQ ID NO: 317 - DNA, 22 bp, Homo sapiens
ccatcatcatattggtgtgacc

SEQ ID NO: 318 - DNA, 18 bp, Homo sapiens
tggctgcccaagaagaag

SEQ ID NO: 319 - DNA, 24 bp, Homo sapiens
ttaagatgccattaaactcatgac

SEQ ID NO: 320 - DNA, 20 bp, Homo sapiens
ccaaggagatgaccaagtgg

SEQ ID NO: 321 - DNA, 22 bp, Homo sapiens
ccatctcttttatcagggttgg

SEQ ID NO: 322 - DNA, 24 bp, Homo sapiens
ctctgtgcaagtaagcatcttaca

SEQ ID NO: 323 - DNA, 20 bp, Homo sapiens
cgactgtgtattttccacag

SEQ ID NO: 324 - DNA, 20 bp, Homo sapiens
agaagcccatatcaatgcac

SEQ ID NO: 325 - DNA, 23 bp, Homo sapiens
agcttaaagtaggacaaccatgg

SEQ ID NO: 326 - DNA, 20 bp, Homo sapiens
ggatgcttcactccagaaag

SEQ ID NO: 327 - DNA, 21 bp, Homo sapiens
tgttgtttatttccacctgcc

SEQ ID NO: 328 - DNA, 18 bp, Homo sapiens
agagtggctgcaggccag

SEQ ID NO: 329 - DNA, 25 bp, Homo sapiens
tttttttttttacacgaatttgagg

SEQ ID NO: 330 - DNA, 23 bp, Homo sapiens
tgaggaagtaaaaacaggtcatc

SEQ ID NO: 331 - DNA, 23 bp, Homo sapiens
atgaaatcttaagcagaatccca

SEQ ID NO: 332 - DNA, 20 bp, Homo sapiens
cacagagtcccagggtctgt

SEQ ID NO: 333 - DNA, 25 bp, Homo sapiens
aaaggcctttatttatctctctctg

SEQ ID NO: 334 - DNA, 18 bp, Homo sapiens
gcctcagagctggtgggt

SEQ ID NO: 335 - DNA, 25 bp, Homo sapiens
gcttctaagtcttagagtcagctgg

SEQ ID NO: 336 - DNA, 19 bp, Homo sapiens
agcccacagtcagcctacc

SEQ ID NO: 337 - DNA, 20 bp, Homo sapiens
ttggttaaatgatgcccaga

SEQ ID NO: 338 - DNA, 18 bp, Homo sapiens
tggtcccactcacatccc

SEQ ID NO: 339 - DNA, 19 bp, Homo sapiens
acacagcatgcagggagag

SEQ ID NO: 340 - DNA, 19 bp, Homo sapiens
atccctggtgcttaggtgg

SEQ ID NO: 341 - DNA, 21 bp, Homo sapiens
gatggaagtagctcctctcgg

SEQ ID NO: 342 - DNA, 21 bp, Homo sapiens
ggaaggccagcaagtactacc

SEQ ID NO: 343 - DNA, 18 bp, Homo sapiens
ccggtgcttggaaagatg

SEQ ID NO: 344 - DNA, 20 bp, Homo sapiens
gaagtgtctctgttggggga

SEQ ID NO: 345 - DNA, 22 bp, Homo sapiens
ttacaggcatgagtcactacgc

SEQ ID NO: 346 - DNA, 21 bp, Homo sapiens
accactctcacagcccttaca

SEQ ID NO: 347 - DNA, 18 bp, Homo sapiens
ccctccctccacacacac

SEQ ID NO: 348 - DNA, 20 bp, Homo sapiens
gctcactgaactttcagggc

SEQ ID NO: 349 - DNA, 20 bp, Homo sapiens
agatacgggcaaaacactgg

SEQ ID NO: 350 - DNA, 21 bp, Homo sapiens
gttgaatatagagcagggccc

SEQ ID NO: 351 - DNA, 20 bp, Homo sapiens
ttctgaggtcagggctgtct

SEQ ID NO: 352 - DNA, 21 bp, Homo sapiens
agcttggaaaatctcgtgtca

SEQ ID NO: 353 - DNA, 18 bp, Homo sapiens
actcagtccctcccaccc

SEQ ID NO: 354 - DNA, 20 bp, Homo sapiens
tcctctcactccttcccaga

SEQ ID NO: 355 - DNA, 19 bp, Homo sapiens
gtgatcacggctcaacctg

SEQ ID NO: 356 - DNA, 18 bp, Homo sapiens
tggaggactgcttgagcc

SEQ ID NO: 357 - DNA, 19 bp, Homo sapiens
ctgcagctgcctcagtttc

SEQ ID NO: 358 - DNA, 20 bp, Homo sapiens
tcaaaagtgctggtgacagc

SEQ ID NO: 359 - DNA, 20 bp, Homo sapiens
atttccagagccagctcaaa

SEQ ID NO: 360 - DNA, 25 bp, Homo sapiens
ctttaatgttgtgatgacacaaagc

SEQ ID NO: 361 - DNA, 20 bp, Homo sapiens
gatcatgcactgttgaccac

SEQ ID NO: 362 - DNA, 25 bp, Homo sapiens
tacatttgaaacatttaaaacctga

SEQ ID NO: 363 - DNA, 24 bp, Homo sapiens
aactgagctgtaaccagactggga

SEQ ID NO: 364 - DNA, 22 bp, Homo sapiens
tggaacagtctggtcctgatgg

SEQ ID NO: 365 - DNA, 25 bp, Homo sapiens
ttatccctttattgtttctcctttg

SEQ ID NO: 366 - DNA, 24 bp, Homo sapiens
tggtcacctgtatttattgctagg

SEQ ID NO: 367 - DNA, 22 bp, Homo sapiens
tcttcaaagcctctgcagtacc

SEQ ID NO: 368 - DNA, 22 bp, Homo sapiens
ctcatctccaacctgtctaacc

SEQ ID NO: 369 - DNA, 24 bp, Homo sapiens
gtggctgcagctaatgtaagacac

SEQ ID NO: 370 - DNA, 24 bp, Homo sapiens
cagcagagacaatggcgtaagtcc

SEQ ID NO: 371 - DNA, 20 bp, Homo sapiens
ctgattgagaaccagaacag

SEQ ID NO: 372 - DNA, 20 bp, Homo sapiens
taaagccctataacctctcc

SEQ ID NO: 373 - DNA, 20 bp, Homo sapiens
tagtaagggaccttcaccag

SEQ ID NO: 374 - DNA, 20 bp, Homo sapiens
agatgtttggtatgacttgg

SEQ ID NO: 375 - DNA, 20 bp, Homo sapiens
gatgattaaactctcctggc

SEQ ID NO: 376 - DNA, 20 bp, Homo sapiens
gagacagctaagcactcatg

SEQ ID NO: 377 - DNA, 19 bp, Homo sapiens
gaggtggtgggcacctgta

SEQ ID NO: 378 - DNA, 20 bp, Homo sapiens
agaggggaggaacacacctt

SEQ ID NO: 379 - DNA, 20 bp, Homo sapiens
gaccagagtctgcccagaag

SEQ ID NO: 380 - DNA, 19 bp, Homo sapiens
tccccagctctatcccaac

SEQ ID NO: 381 - DNA, 20 bp, Homo sapiens
ggagggatggacaagtctga

SEQ ID NO: 382 - DNA, 20 bp, Homo sapiens
gtccagctcgctgactatcc

SEQ ID NO: 383 - DNA, 20 bp, Homo sapiens
tcaaaacacagtcatctcca

SEQ ID NO: 384 - DNA, 20 bp, Homo sapiens
gcaaaggctttaccatattg

SEQ ID NO: 385 - DNA, 16 bp, Homo sapiens
gctcagcacccccatt

SEQ ID NO: 386 - DNA, 16 bp, Homo sapiens
tccctgctcgggaaac

SEQ ID NO: 387 - DNA, 20 bp, Homo sapiens
gttctccagagagacagcac

SEQ ID NO: 388 - DNA, 19 bp, Homo sapiens
gagagcaacactattgccc

SEQ ID NO: 389 - DNA, 21 bp, Homo sapiens
tatagacttcagccctgctgc

SEQ ID NO: 390 - DNA, 20 bp, Homo sapiens
cctctgtaggatgcagttgg

SEQ ID NO: 391 - DNA, 20 bp, Homo sapiens
ttgctacgcactcctctact

SEQ ID NO: 392 - DNA, 20 bp, Homo sapiens
gtgaaggcaggaaatgtgac

SEQ ID NO: 393 - DNA, 20 bp, Homo sapiens
atcctagaccagaggagccc

SEQ ID NO: 394 - DNA, 20 bp, Homo sapiens
ctccccctggtccagttatt

SEQ ID NO: 395 - DNA, 20 bp, Homo sapiens
aactttcatttgccaaggga

SEQ ID NO: 396 - DNA, 20 bp, Homo sapiens
agcagatctgctcttgcgat

SEQ ID NO: 397 - DNA, 20 bp, Homo sapiens
acagttgtcatcggtaggca

SEQ ID NO: 398 - DNA, 22 bp, Homo sapiens
aaaagtatgaatgggatggagc

SEQ ID NO: 399 - DNA, 20 bp, Homo sapiens
gtgcaggtggcgtttatttt

SEQ ID NO: 400 - DNA, 21 bp, Homo sapiens
ccctatatctccgtgtgctcc

SEQ ID NO: 401 - DNA, 21 bp, Homo sapiens
gctctagtgggaaacctcagg

SEQ ID NO: 402 - DNA, 20 bp, Homo sapiens
gaattccaggctcttgcttg

SEQ ID NO: 403 - DNA, 20 bp, Homo sapiens
ggtttggtctcaaaggcaaa

SEQ ID NO: 404 - DNA, 20 bp, Homo sapiens
ccagtacatggtggtcacca

SEQ ID NO: 405 - DNA, 20 bp, Homo sapiens
gctgccttggaatttctgtt

SEQ ID NO: 406 - DNA, 18 bp, Homo sapiens
gtgctgtggtggggaaag

SEQ ID NO: 407 - DNA, 20 bp, Homo sapiens
attcaagctcatccagaccc

SEQ ID NO: 408 - DNA, 20 bp, Homo sapiens
ggactggccctttgaaactc

SEQ ID NO: 409 - DNA, 22 bp, Homo sapiens
atattgaccgtgcacaaatacg

SEQ ID NO: 410 - DNA, 21 bp, Homo sapiens
agacctgggaaaagtggagaa

SEQ ID NO: 411 - DNA, 20 bp, Homo sapiens
attggcagtggaaaatgctt

SEQ ID NO: 412 - DNA, 25 bp, Homo sapiens
ttaatcttttgtcaacttcctgatt

SEQ ID NO: 413 - DNA, 23 bp, Homo sapiens
tctgtcctcctttcaccggaagc

SEQ ID NO: 414 - DNA, 29 bp, Homo sapiens
ggataaagaaactccgctctgctggtaga

SEQ ID NO: 415 - DNA, 25 bp, Homo sapiens
tcagggcctgtgttgccgcactctg

SEQ ID NO: 416 - DNA, 25 bp, Homo sapiens
agcgatgtaaagggtaccagtgccg

SEQ ID NO: 417 - DNA, 18 bp, Homo sapiens
aggcatgcaagcttctta

SEQ ID NO: 418 - DNA, 18 bp, Homo sapiens
ccgggaggagacatctat

SEQ ID NO: 419 - DNA, 19 bp, Homo sapiens
tggtaagcacagaaaatgc

SEQ ID NO: 420 - DNA, 18 bp, Homo sapiens
aatggatgggggattatt

SEQ ID NO: 421 - DNA, 18 bp, Homo sapiens
ctggacgttatgtctgcc

SEQ ID NO: 422 - DNA, 18 bp, Homo sapiens
agaggcccagtcacagat

SEQ ID NO: 423 - DNA, 19 bp, Homo sapiens
atcactctgaactgccact

SEQ ID NO: 424 - DNA, 20 bp, Homo sapiens
cccttctgtttttctgtttt

SEQ ID NO: 425 - DNA, 18 bp, Homo sapiens
caagctttgaaggaagag

SEQ ID NO: 426 - DNA, 19 bp, Homo sapiens
taggacgttaagtgaggac

SEQ ID NO: 427 - DNA, 18 bp, Homo sapiens
gctctgcagtgggtaaaa

SEQ ID NO: 428 - DNA, 18 bp, Homo sapiens
actctccaagactgtgcg

SEQ ID NO: 429 - DNA, 18 bp, Homo sapiens
ccctttctgaggcaagat

SEQ ID NO: 430 - DNA, 18 bp, Homo sapiens
gaccacctgggagagaac

SEQ ID NO: 431 - DNA, 18 bp, Homo sapiens
cgctatgagtcccatctg

SEQ ID NO: 432 - DNA, 18 bp, Homo sapiens
gatcagctgcaatgaagg

SEQ ID NO: 433 - DNA, 18 bp, Homo sapiens
ttgagtacacggggtgac

SEQ ID NO: 434 - DNA, 18 bp, Homo sapiens
cgcaggactgaaagatga

SEQ ID NO: 435 - DNA, 18 bp, Homo sapiens
acctgtctcctctcctgg

SEQ ID NO: 436 - DNA, 18 bp, Homo sapiens
tgcttttcttctgtggga

SEQ ID NO: 437 - DNA, 18 bp, Homo sapiens
atgaccagcaagcattgt

SEQ ID NO: 438 - DNA, 18 bp, Homo sapiens
gtactgggattacaggcg

SEQ ID NO: 439 - DNA, 18 bp, Homo sapiens
gcagaaggtcctttggat

SEQ ID NO: 440 - DNA, 18 bp, Homo sapiens
tttgcaggattcatgctt

SEQ ID NO: 441 - DNA, 19 bp, Homo sapiens
cgacattcttttctggagg

SEQ ID NO: 442 - DNA, 19 bp, Homo sapiens
acctttgcatgttggtttt

SEQ ID NO: 443 - DNA, 18 bp, Homo sapiens
gcacttttccttccttcc

SEQ ID NO: 444 - DNA, 18 bp, Homo sapiens
tgctttgctttcttctgg

SEQ ID NO: 445 - DNA, 19 bp, Homo sapiens
acagctccagagagaagga

SEQ ID NO: 446 - DNA, 19 bp, Homo sapiens
gcagtcacttgaaaccaga

SEQ ID NO: 447 - DNA, 18 bp, Homo sapiens
aggcatcaagctttcctt

SEQ ID NO: 448 - DNA, 18 bp, Homo sapiens
ggtttagagaaccgagcc

SEQ ID NO: 449 - DNA, 18 bp, Homo sapiens
gtggtgctgcaagttacc

SEQ ID NO: 450 - DNA, 18 bp, Homo sapiens
ggaatccctttctttcca

SEQ ID NO: 451 - DNA, 18 bp, Homo sapiens
gaccatttgttacgcagc

SEQ ID NO: 452 - DNA, 19 bp, Homo sapiens
gatgggtgtgaatgaacaa

SEQ ID NO: 453 - DNA, 19 bp, Homo sapiens
ctcaagcttctgttcatgc

SEQ ID NO: 454 - DNA, 18 bp, Homo sapiens
gctgtgagtgtcttggct

SEQ ID NO: 455 - DNA, 18 bp, Homo sapiens
tacagaaaaccgcagctc

SEQ ID NO: 456 - DNA, 18 bp, Homo sapiens
gccaccaaaggaaagatt

SEQ ID NO: 457 - DNA, 18 bp, Homo sapiens
aaaaggagggaatcatgg

SEQ ID NO: 458 - DNA, 18 bp, Homo sapiens
tcacttagcaggaggcag

SEQ ID NO: 459 - DNA, 18 bp, Homo sapiens
ctgagcatccgatgagac

SEQ ID NO: 460 - DNA, 18 bp, Homo sapiens
gtgcaaaatgagcagctt

SEQ ID NO: 461 - DNA, 18 bp, Homo sapiens
tctaaccccttactgggc

SEQ ID NO: 462 - DNA, 18 bp, Homo sapiens
tcctcaaactgggaatga

SEQ ID NO: 463 - DNA, 18 bp, Homo sapiens
tttacacaggaccaggga

SEQ ID NO: 464 - DNA, 18 bp, Homo sapiens
atctcccccactcagaag

SEQ ID NO: 465 - DNA, 18 bp, Homo sapiens
gtccacgggctttattct

SEQ ID NO: 466 - DNA, 22 bp, Homo sapiens
tgagcataaatttcattagctg

SEQ ID NO: 467 - DNA, 20 bp, Homo sapiens
ggaagagcaaaataaatcca

SEQ ID NO: 468 - DNA, 19 bp, Homo sapiens
ggtgcacagaattgttcat

SEQ ID NO: 469 - DNA, 18 bp, Homo sapiens
agcacgcttatttcatgg

SEQ ID NO: 470 - DNA, 18 bp, Homo sapiens
gtaacaccagcagggaca

SEQ ID NO: 471 - DNA, 18 bp, Homo sapiens
tcctgctgcattatggat

SEQ ID NO: 472 - DNA, 18 bp, Homo sapiens
gggggtgagaagtaggaa

SEQ ID NO: 473 - DNA, 18 bp, Homo sapiens
atggggattaaatacggg

SEQ ID NO: 474 - DNA, 18 bp, Homo sapiens
agctagcattgggctctt

SEQ ID NO: 475 - DNA, 18 bp, Homo sapiens
ctgaggagaagaggctgg

SEQ ID NO: 476 - DNA, 18 bp, Homo sapiens
cgccttacaaggcaagta

SEQ ID NO: 477 - DNA, 18 bp, Homo sapiens
aggatgcttgctagggtt

SEQ ID NO: 478 - DNA, 18 bp, Homo sapiens
cacaagtgtctggaaggc

SEQ ID NO: 479 - DNA, 18 bp, Homo sapiens
ggtctcaggagcccttta

SEQ ID NO: 480 - DNA, 21 bp, Homo sapiens
acatgccactcttctcactaa

SEQ ID NO: 481 - DNA, 18 bp, Homo sapiens
acttaaccaaggatgggg

SEQ ID NO: 482 - DNA, 18 bp, Homo sapiens
caacccacgagcataaga

SEQ ID NO: 483 - DNA, 18 bp, Homo sapiens
taggctctgcactcttgg

SEQ ID NO: 484 - DNA, 18 bp, Homo sapiens
acccacggagtctctctc

SEQ ID NO: 485 - DNA, 18 bp, Homo sapiens
taaaggcggtgaagtgag

SEQ ID NO: 486 - DNA, 18 bp, Homo sapiens
ctaccgctctcctaggct

SEQ ID NO: 487 - DNA, 18 bp, Homo sapiens
tggggccagataattctt

SEQ ID NO: 488 - DNA, 18 bp, Homo sapiens
ctggtgtttggtggtgtt

SEQ ID NO: 489 - DNA, 18 bp, Homo sapiens
aaggaagaggtcaccagg

SEQ ID NO: 490 - DNA, 18 bp, Homo sapiens
cacaaattccatttccca

SEQ ID NO: 491 - DNA, 21 bp, Homo sapiens
tcaataggtgatccaacattt

SEQ ID NO: 492 - DNA, 18 bp, Homo sapiens
aaagtcccacaaagggtc

SEQ ID NO: 493 - DNA, 18 bp, Homo sapiens
gggtagggggatcttttt

SEQ ID NO: 494 - DNA, 18 bp, Homo sapiens
tgtggaacattcattggc

SEQ ID NO: 495 - DNA, 18 bp, Homo sapiens
gtcctgggaaagatggaa

SEQ ID NO: 496 - DNA, 18 bp, Homo sapiens
tcaaagcgtctcccataa

SEQ ID NO: 497 - DNA, 18 bp, Homo sapiens
tctttcgctgtacttggc

SEQ ID NO: 498 - DNA, 18 bp, Homo sapiens
tgggaggtcagagtgatg

SEQ ID NO: 499 - DNA, 19 bp, Homo sapiens
ggacagtgtatgtgttggg

SEQ ID NO: 500 - DNA, 18 bp, Homo sapiens
aggcagctgtttttgtga

SEQ ID NO: 501 - DNA, 18 bp, Homo sapiens
cttcttgagtcccgtgtg

SEQ ID NO: 502 - DNA, 19 bp, Homo sapiens
caaccgagaatcctctagc

SEQ ID NO: 503 - DNA, 18 bp, Homo sapiens
gctgggagagaatcacaa

SEQ ID NO: 504 - DNA, 18 bp, Homo sapiens
gctttgcagaagagacca

SEQ ID NO: 505 - DNA, 18 bp, Homo sapiens
acgctgtcaggtcacact

SEQ ID NO: 506 - DNA, 18 bp, Homo sapiens
ggaggatgctcaggtgat

SEQ ID NO: 507 - DNA, 18 bp, Homo sapiens
tagggggatctttttcca

SEQ ID NO: 508 - DNA, 18 bp, Homo sapiens
gagcaatttgaaaagcca

SEQ ID NO: 509 - DNA, 18 bp, Homo sapiens
atggtccagctcctctgt

SEQ ID NO: 510 - DNA, 18 bp, Homo sapiens
atagagcaccccatctcc

SEQ ID NO: 511 - DNA, 18 bp, Homo sapiens
aacattgctgttagccca

SEQ ID NO: 512 - DNA, 18 bp, Homo sapiens
gcaatcgaaacagcattc

SEQ ID NO: 513 - DNA, 18 bp, Homo sapiens
atgagttggcagctgaag

SEQ ID NO: 514 - DNA, 18 bp, Homo sapiens
aatgaaggtcttgcctcc

SEQ ID NO: 515 - DNA, 20 bp, Homo sapiens
gaggagaagatccacaagcg

SEQ ID NO: 516 - DNA, 20 bp, Homo sapiens
tctctggggcatactgaacc

SEQ ID NO: 517 - DNA, 18 bp, Homo sapiens
ctgagcttttggcactgt

SEQ ID NO: 518 - DNA, 18 bp, Homo sapiens
ctgctaggtgacagcagg

SEQ ID NO: 519 - DNA, 20 bp, Homo sapiens
tgtatgagtctggagggtgt

SEQ ID NO: 520 - DNA, 18 bp, Homo sapiens
acacctggctgaggaaat

SEQ ID NO: 521 - DNA, 18 bp, Homo sapiens
gcaggggacgtgataata

SEQ ID NO: 522 - DNA, 18 bp, Homo sapiens
ttttgcttcctaccatgc

SEQ ID NO: 523 - DNA, 18 bp, Homo sapiens
aaaattgtgagcacctcc

SEQ ID NO: 524 - DNA, 23 bp, Homo sapiens
tttatatttaaagtggctttgtt

SEQ ID NO: 525 - DNA, 18 bp, Homo sapiens
gtgcaaagcccacagtat

SEQ ID NO: 526 - DNA, 18 bp, Homo sapiens
aggaaaatgcaagagcag

SEQ ID NO: 527 - DNA, 20 bp, Homo sapiens
ccactgaattgcatactttg

SEQ ID NO: 528 - DNA, 18 bp, Homo sapiens
tctgggtccagtctgcta

SEQ ID NO: 529 - DNA, 18 bp, Homo sapiens
agattttggggagtcagg

SEQ ID NO: 530 - DNA, 17 bp, Homo sapiens
gcgctcaagcaattctc

SEQ ID NO: 531 - DNA, 18 bp, Homo sapiens
caagccccaaagtagtca

SEQ ID NO: 532 - DNA, 18 bp, Homo sapiens
gaatcatccaatccacga

SEQ ID NO: 533 - DNA, 18 bp, Homo sapiens
agcctccaggtgactacc

SEQ ID NO: 534 - DNA, 18 bp, Homo sapiens
gaaggacatggtcagcag

SEQ ID NO: 535 - DNA, 18 bp, Homo sapiens
atgctttcagcattttcg

SEQ ID NO: 536 - DNA, 18 bp, Homo sapiens
tgatccgtggtagggtta

SEQ ID NO: 537 - DNA, 18 bp, Homo sapiens
gtcggattggtttcacaa

SEQ ID NO: 538 - DNA, 19 bp, Homo sapiens
ttttatgggaatttcagcc

SEQ ID NO: 539 - DNA, 21 bp, Homo sapiens
tttggaaaagaacagaaatgt

SEQ ID NO: 540 - DNA, 19 bp, Homo sapiens
ggctagtctttcctgaacc

SEQ ID NO: 541 - DNA, 18 bp, Homo sapiens
ccttaatgcccctgattc

SEQ ID NO: 542 - DNA, 18 bp, Homo sapiens
gcgtttacaagctgagga

SEQ ID NO: 543 - DNA, 18 bp, Homo sapiens
tcaagcttgctttctcaa

SEQ ID NO: 544 - DNA, 18 bp, Homo sapiens
gtagcccagcaagtgtct

SEQ ID NO: 545 - DNA, 18 bp, Homo sapiens
cctggctggagataggat

SEQ ID NO: 546 - DNA, 18 bp, Homo sapiens
cttcccctctgcctatgt

SEQ ID NO: 547 - DNA, 18 bp, Homo sapiens
ggcacgtacttcctacca

SEQ ID NO: 548 - DNA, 18 bp, Homo sapiens
ggtgcttcttacaggcaa

SEQ ID NO: 549 - DNA, 16 bp, Homo sapiens
acccaggctggtgtgt

SEQ ID NO: 550 - DNA, 23 bp, Homo sapiens
actgagttaattatcactcccct

SEQ ID NO: 551 - DNA, 18 bp, Homo sapiens
gatgcattttgcttcacc

SEQ ID NO: 552 - DNA, 21 bp, Homo sapiens
tctgcttttagagctgttagc

SEQ ID NO: 553 - DNA, 19 bp, Homo sapiens
tcaagcttcaaagagcaga

SEQ ID NO: 554 - DNA, 18 bp, Homo sapiens
ggagtacatcccaggacc

SEQ ID NO: 555 - DNA, 19 bp, Homo sapiens
tggtgcttttaaatccaga

SEQ ID NO: 556 - DNA, 21 bp, Homo sapiens
ctcccttacttacttgcattg

SEQ ID NO: 557 - DNA, 18 bp, Homo sapiens
tcttctcccagggaatct

SEQ ID NO: 558 - DNA, 18 bp, Homo sapiens
tttatgtcccctgagcac

SEQ ID NO: 559 - DNA, 19 bp, Homo sapiens
tccctggctatcttgaatc

SEQ ID NO: 560 - DNA, 16 bp, Homo sapiens
cttgactgggtccacg

SEQ ID NO: 561 - DNA, 20 bp, Homo sapiens
cgagacgccagtagatacca

SEQ ID NO: 562 - DNA, 20 bp, Homo sapiens
catcctccatgcctttcagt

SEQ ID NO: 563 - DNA, 20 bp, Homo sapiens
agttccagagaacgagacgc

SEQ ID NO: 564 - DNA, 20 bp, Homo sapiens
cttgtcatcctccatgcctt

SEQ ID NO: 565 - DNA, 20 bp, Homo sapiens
gagcgtgagaggttgaggag

SEQ ID NO: 566 - DNA, 20 bp, Homo sapiens
aaacaaactccagacgcacc

SEQ ID NO: 567 - DNA, 24 bp, Homo sapiens
ctgaaccactacctgtatgacctg

SEQ ID NO: 568 - DNA, 25 bp, Homo sapiens
ctaactacttactcctacagggccc

SEQ ID NO: 569 - DNA, 23 bp, Homo sapiens
gaagcatttcaatactttaactg

SEQ ID NO: 570 - DNA, 20 bp, Homo sapiens
ccactccagtgcacccaatc

SEQ ID NO: 571 - DNA, 20 bp, Homo sapiens
cttctcctggccactctgac

SEQ ID NO: 572 - DNA, 21 bp, Homo sapiens
ggtttacctttgaatcccagc

SEQ ID NO: 573 - DNA, 22 bp, Homo sapiens
tgaggatgaatgagcacatagg

SEQ ID NO: 574 - DNA, 21 bp, Homo sapiens
tttgtggtccattgagtaggc

SEQ ID NO: 575 - DNA, 20 bp, Homo sapiens
aggggaaggaatgtgcttgg

SEQ ID NO: 576 - DNA, 20 bp, Homo sapiens
ttcggctgagcgggcagtgt

SEQ ID NO: 577 - DNA, 26 bp, Homo sapiens
attgaaggtcctccaaaagaatgctg

SEQ ID NO: 578 - DNA, 30 bp, Homo sapiens
agaacgtcaacatatctttttgggggacac

SEQ ID NO: 579 - DNA, 22 bp, Homo sapiens
ttgtatttgaggactttgctcg

SEQ ID NO: 580 - DNA, 20 bp, Homo sapiens
cggtaccatcctcctcttcc

SEQ ID NO: 581 - DNA, 20 bp, Homo sapiens
tttttgcctcatctatgccc

SEQ ID NO: 582 - DNA, 20 bp, Homo sapiens
gggtgacagagcaagactcc

SEQ ID NO: 583 - DNA, 18 bp, Homo sapiens
ttgctcaagttctcctgg

SEQ ID NO: 584 - DNA, 18 bp, Homo sapiens
accttgttttgaggggag

SEQ ID NO: 585 - DNA, 18 bp, Homo sapiens
cttggctatttggacagc

SEQ ID NO: 586 - DNA, 18 bp, Homo sapiens
gggcatttactcacttgc

SEQ ID NO: 587 - DNA, 19 bp, Homo sapiens
cttgtgtcagttgtcaggg

SEQ ID NO: 588 - DNA, 19 bp, Homo sapiens
tggaattgttgtgtcttgg

SEQ ID NO: 589 - DNA, 18 bp, Homo sapiens
ccagttccactggatgtt

SEQ ID NO: 590 - DNA, 18 bp, Homo sapiens
atgggctgtgtttctcaa

SEQ ID NO: 591 - DNA, 18 bp, Homo sapiens
ctgcctatccctggactt

SEQ ID NO: 592 - DNA, 18 bp, Homo sapiens
agtttgtccctagtgccc

SEQ ID NO: 593 - DNA, 19 bp, Homo sapiens
caacacgtctgacatccat

SEQ ID NO: 594 - DNA, 16 bp, Homo sapiens
ggatagtgcacaccca

SEQ ID NO: 595 - DNA, 22 bp, Homo sapiens
tgggtggtactattgttcccat

SEQ ID NO: 596 - DNA, 20 bp, Homo sapiens
agttccagcccccttaccag

SEQ ID NO: 597 - DNA, 20 bp, Homo sapiens
ggccactatcatccctgtgt

SEQ ID NO: 598 - DNA, 20 bp, Homo sapiens
tttcacatgggaagaacacg

SEQ ID NO: 599 - DNA, 20 bp, Homo sapiens
acagtgacactagggacggg

SEQ ID NO: 600 - DNA, 20 bp, Homo sapiens
tgccaggatggagataacaa

SEQ ID NO: 601 - DNA, 20 bp, Homo sapiens
cctgtggcacacatatcacc

SEQ ID NO: 602 - DNA, 20 bp, Homo sapiens
acaaccaagaatggagccac

SEQ ID NO: 603 - DNA, 20 bp, Homo sapiens
tgctgtgtaacaagtcccca

SEQ ID NO: 604 - DNA, 20 bp, Homo sapiens
tgaacggaggacctaccaag

SEQ ID NO: 605 - DNA, 20 bp, Homo sapiens
gcagggtccgactcactaag

SEQ ID NO: 606 - DNA, 20 bp, Homo sapiens
gctgtgagttccctttacgc

SEQ ID NO: 607 - DNA, 20 bp, Homo sapiens
acagtggggacaaagacagg

SEQ ID NO: 608 - DNA, 20 bp, Homo sapiens
tacagggcacctcccagtag

SEQ ID NO: 609 - DNA, 21 bp, Homo sapiens
tcttctgttaaggtttccccc

SEQ ID NO: 610 - DNA, 20 bp, Homo sapiens
tgtctcaaacctccctctgc

SEQ ID NO: 611 - DNA, 20 bp, Homo sapiens
aacatatttcctccccagcc

SEQ ID NO: 612 - DNA, 19 bp, Homo sapiens
cagtcccagccaatgagaa

SEQ ID NO: 613 - DNA, 20 bp, Homo sapiens
ctcctctgcatgggagaatc

SEQ ID NO: 614 - DNA, 20 bp, Homo sapiens
agacctgggaccagtctgtg

SEQ ID NO: 615 - DNA, 20 bp, Homo sapiens
gggagacgacgtcacaagat

SEQ ID NO: 616 - DNA, 20 bp, Homo sapiens
tgatgttgggaagatggtga

SEQ ID NO: 617 - DNA, 20 bp, Homo sapiens
caggcatcttctatgtgcca

SEQ ID NO: 618 - DNA, 20 bp, Homo sapiens
gggaggcacaagttctttca

SEQ ID NO: 619 - DNA, 20 bp, Homo sapiens
acttcgtggcactgagtgtg

SEQ ID NO: 620 - DNA, 20 bp, Homo sapiens
cctttcttacggatgaggca

SEQ ID NO: 621 - DNA, 20 bp, Homo sapiens
ggctgctgagctcttctgat

SEQ ID NO: 622 - DNA, 20 bp, Homo sapiens
tgggtctctctgcctgactt

SEQ ID NO: 623 - DNA, 20 bp, Homo sapiens
tcacctacttccagcttccg

SEQ ID NO: 624 - DNA, 20 bp, Homo sapiens
agacctgggaccagtctgtg

SEQ ID NO: 625 - DNA, 20 bp, Homo sapiens
ctcctctgcatgggagaatc

SEQ ID NO: 626 - DNA, 20 bp, Homo sapiens
aattcaggagacctgggacc

SEQ ID NO: 627 - DNA, 15 bp, Artificial Sequence
  Artificial Sequence is a BstXI-linker adapter.
gtcttcaccacgggg

SEQ ID NO: 628 - DNA, 11 bp, Artificial Sequence
  Artificial Sequence is a BstXI-linker adapter.
gtggtgaagac

SEQ ID NO: 629 - DNA, 18 bp, Artificial Sequence
  Artificial Sequence is a primer.
ccaagttctgagaagtcc

SEQ ID NO: 630 - DNA, 17 bp, Artificial Sequence
  Artificial Sequence is a primer.
aatacctgaaaccatac

SEQ ID NO: 631 - DNA, 17 bp, Artificial Sequence
  Artificial Sequence is an allele specific oligonucleotide.
agactggggtgagacgc

SEQ ID NO: 632 - DNA, 19 bp, Artificial Sequence
  Artificial Sequence is an allele specific oligonucleotide.
cagactgggttgagacgcc

SEQ ID NO: 633 - DNA, 24 bp, Artificial Sequence
  Artificial Sequence is a primer.
cccgtgtgctccgccgcccagttc

SEQ ID NO: 634 - DNA, 25 bp, Artificial Sequence
  Artificial Sequence is a primer.
ggctcacggagctcatcatggactt

SEQ ID NO: 635 - DNA, 502 bp, Artificial Sequence
  Artificial Sequence is a primer.
cccgtgtgctccgccgcccagttcccctgcgcgcggggtcagtgtgtggacctgcgcctgcgctgcgacggcgaggcagactgtcaggaccgctcagacgaggtggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcc

SEQ ID NO: 636 - DNA, 21 bp, Artificial Sequence
  Artificial Sequence is a primer.
agcgaggccaccatccacagg

SEQ ID NO: 637 - DNA, 21 bp, Artificial Sequence
  Artificial Sequence is a primer.
tcgctggtcggcataatcaat

SEQ ID NO: 638 - DNA, 501 bp, Artificial Sequence
  Artificial Sequence is a primer.
agcagagccaccatccacaggatctccctggagactaacaacaacgatgtggctatcccactcacgggtgtcaaagaggcctctgcactggactttgatgtgtccaacaatcacatctactggactgatgttagcctcaagacgatcagccgagccttcatgaatgggagctcagtggagcacgtgattgagtttggcctcgactaccctgaaggaatggctgtggactggatgggcaagaacctctattgggcggacacagggaccaacaggattgaggtggcccggctggatgggcagttccggcaggtgcttgtgtggagagaccttgacaaccccaggtctctggctctggatcctactaaaggctacatctactggactgagtggggtggcaagccaaggattgtgcgggccttcatggatgggaccaattgtatgacactggtagacaaggtgggccgggccaacgacctcaccattgattatgccgaccagcga

SEQ ID NO: 639 - RNA, 26 nt, Artificial Sequence
  Artificial Sequence is a Zmax1 oligonucleotide.
raguacagcuucuugccaacccaguc

SEQ ID NO: 640 - RNA, 26 nt, Artificial Sequence
  Artificial Sequence is a Zmax1 oligonucleotide.
ruccuccaggucgauggucagcccau

SEQ ID NO: 641 - RNA, 26 nt, Artificial Sequence
  Artificial Sequence is a Zmax1 oligonucleotide.
rgucugaguccgaguucaaauccagg

SEQ ID NO: 642 - DNA, 3081 bp, Homo sapiens
cccgccagcccagcccagcccaaccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccttgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgcccacagatgtgaaatgaatgtaatctaatagaagcctaatcagcccaccatgttctccactgaaaaatcctctttctttggggtttttctttctttcttttttgattttgcactggacggtgacgtcagcctgtacaggctcccaggggtggcgtcaaatgctattgaaattgcgctgaatcgtatgctttttccttttgataaataaacaatgtaaaaatgtttcaaaaacctaataaaataaataaatacg

SEQ ID NO: 643 - DNA, 1324 bp, Homo sapiens
  misc_feature (1)...(1324): n = A,T,C or G
ggccgcccggcgcccccagcagnccgagccggggcgcacagncggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacagggaggttgggaggggggacagaggggagacagaggcacggagagaaaggaatgtttagcacaagacacagcggagctcgggattggctaatctcccatagtatttatggtggcgccggcggggccccagcccagcttgcaggccacctctagctttcttcctaccccattccggcttccctcctcctcccctgcagcctggttaggtggatacctgccctgacatgtgaggcaagctaaggcctggagggtcagatgggagaccaggtcccaagggagcaagacctgcgaagcgcagcagccccggcccttcccccgttttgaacatgtgtaaccgacagtctgccctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtact

SEQ ID NO: 644 - DNA, 2377 bp, Homo sapiens
ggtgacaaagagccaacagagacaataggagacttgtcaatttgtcttgatgggctacagttagagtctgaagttgttaccaatggtgaaactacatgttcagaaagtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttaaaaaaaaaaaaaaaaaaa

SEQ ID NO: 645 - DNA, 1295 bp, Homo sapiens
gggccgccgcccacccgggccttgcctctacctcagtcgttgccccccgattttcggctggagcccacggccccggccctcagcccccgctctagcttcgccagtagctcggccagcgacgcgagcaagccgtccagcccccggggcagcctgctgctggacggggcgggggctggcggagctggaggtagccggccctgcagcaatcgcaccagcggcatcagcatgggctacgaccagcgccacgggagccccttgccagcggggccgtgcctgtttggcccacccctggccggagcaccggcaggctattctcccggaggggtcccgtccgcctacccggagctccacgccgccctggaccgattgtacgctcagcggcccgcggggttcggctgccaggaaagccgccactcgtatcccccggccctgggcagccctggagctctagccggggcccgagtgggagcggcggggcccttggagagacggggggcgcaacccggacgacactctgtgaccggctacggggactgcgccgtgggcgcccggtaccaggacgagctaacagctttgcttcgcctgacggtgggcaccggtgggcgagaagccggagcccgcggagaaccctcggggattgagccgtcgggtctggaggagccaccaggtcctttcgttccggaggccgcccgggcccggatgcgggagccagaggccagggaggactacttcggcacctgtatcaagtgcaacaaaggcatctatgggcagagcaatgcctgccaggccctggacagcctctaccacacccagtgctttgtttgctgctcttgtgggcgaactttgcgttgcaaggctttctacagtgtcaatggctctgtgtactgtgaggaagattatctgttttcagggtttcaggaggcagctgagaaatgctgtgtctgtggtcacttgattttggagaagatcctacaagcaatggggaagtcctatcatccaggctgtttccgatgcattgtttgcaacaagtgcctggatggcatccccttcacagtggacttctccaaccaagtatactgtgtcaccgactaccacaaaaattatgctcctaagtgtgcagcctgtggccaacccatcctcccctctgagggctgtgaggacatcgtgagggtgatatccatggaccgggattatcactttgagtgctaccactgtgaggactgccggatgcagctgagtgatgaggaaggctgctgctgtttccctctggatgggcacttgctctgccatggttg

SEQ ID NO: 646 - DNA, 3411 bp, Homo sapiens
gggcccggggtcccgccaccaccgcgcgcgggacagattgattcactttggagctgtaagtactgatgtattagggtgcagcgctcattgttcattgacgcagagtcccaaaatgaatatccaagagcagggtttccccttggacctcggagcaagtttcaccgaagatgctccccgacccccagtgcctggtgaggagggagaactggtgtccacagacccgaggcccgccagctacagtttctgctccgggaaaggtgttggcattaaaggtgagacttcgacggccactccgaggcgctcggatctggacctggggtatgagcctgagggcagtgcctcccccaccccaccatacttgaagtgggctgagtcactgcattccctgctggatgaccaagatgggataagcctgttcaggactttcctgaagcaggagggctgtgccgacttgctggacttctggtttgcctgcactggcttcaggaagctggagccctgtgactcgaacgaggagaagaggctgaagctggcgagagccatctaccgaaagtacattcttgataacaatggcatcgtgtcccggcagaccaagccagccaccaagagcttcataaagggctgcatcatgaagcagctgatcgatcctgccatgtttgaccaggcccagaccgaaatccaggccactatggaggaaaacacctatccctccttccttaagtctgatatttatttggaatatacgaggacaggctcggagagccccaaagtctgtagtgaccagagctctgggtcagggacagggaagggcatatctggatacctgccgaccttaaatgaagatgaggaatggaagtgtgaccaggacatggacgaggacgatggcagagacgctgctccccccggaagactccctcagaagctgctcctggagacagctgccccgagggtctcctccagtagacggtacagcgaaggcagagagttcaggtatggatcctggcgggagccagtcaacccctattatgtcaatgccggctatgccctggccccagccaccagtgccaacgacagcgagcagcagagcctgtccagcgatgcagacaccctgtccctcacggacagcagcgtggatgggatccccccatacaggatccgtaagcagcaccgcagggagatgcaggagagcgcgcaggtcaatgggcgggtgcccctacctcacattccccgcacgtaccgggtgccgaaggaggtccgcgtggagcctcagaagttcgcggaggagctcatccaccgcctggaggctgtgcagcgcacgcgggaggccgaggagaagctggaggagcggctgaagcgcgtgcgcatggaggaggaaggtgaggacggcgatccatcgtcagggcccccagggccgtgtcacaagctgcctcccgcccccgcttggcaccacttcccgccccgcttgtgttggacatgggcttgtgccgggctccgggatgcacacgaggagaaccctgagagcatcctggacgagcacgtacagcgtgtgctgaggacaactggccgccagtcgcctgggcctggccatcgctccccggacagtgggcacgtggccaagatgccagtggcactggggggtgccgcctcggggcacgggaagcacgtacccaagtcaggggcgaagctggacgcggccggcctgcaccaccaccgacacgtccaccaccacgtccaccacagcacagcccggcccaaggagcaggtggaggccgaggccacccgcagggcccagagcagcttcgcctggggcctggaaccacacagccatggggcaaggtcccgaggctactcagagagtgttggcgctgcccccaacgccagtgatggcctcgcccacagtgggaaggtgggcgttgcgtgcaaaagaaatgccaagaaggctgagtcggggaagagcgccagcaccgaggtgccaggtgcctcggaggatgcggagaagaaccagaaaatcatgcagtggatcattgagggggaaaaggagatcagcaggcaccgcaggaccggccacgggtcttcggggacgaggaagccacagccccatgagaactccagaccyttgtcccttgagcacccctgggccggccctcagctccggacctccgtgcagccctcccacctcttcatccaagaccccaccatgccaccccacccagctcccaaccccctaacccagctggaggaggcgcgccgacgtctggaggaggaagaaaagagagccagccgagcaccctccaagcagaggtatgtgcaggaggttatgcggcggggacgcgcctgcgtcaggccagcgtgcgcgccggtgctgcacgtggtaccagccgtgtcggacatggagctctccgagacagagacaagatcgcagaggaaggtgggcggcgggagtgcccagccgtgtgacagcatcgttgtggcgtactacttctgcggggaacccatcccctaccgcaccctggtgaggggccgcgctgtcaccctgggccagttcaaggagctgctgaccaaaaagggcagctacagatactacttcaagaaagtgagcgacgagtttgactgtggggtggtgtttgaggaggttcgagaggacgaggccgtcctgcccgtctttgaggagaagatcatcggcaaagtggagaaggtggactgataggctggtgggctggccgctgtgccaggcgaggcccttggcgggcacgggtgtcacggccaggcagatgacctcgtactcaggagcccgatggggaacagtgttgggtgtaccacccatccctgtggtctacccgtgtctagaggcaggtagggggtccctccaagtggtccacaagcttctgtcctgcccccaaggaggcagcctggaccactcctcatagcaatacttggagggcccagcccaagtgaggcagccgaggtccctgctgccagcttcaggtgacccccccccatcccccggcacctcccttgggcacgtgtgctgggatctactttccctctgggatttgcccacgtacccaggtctggctggggcccaggcccggatgcagaggcctgcagggcctctgtcaattgtacgcgccaccaagtgccttcaacacagcttgtctcttgcctgccactgtgtgaatcggcgacggagcactgcacctgcctccagccgccggctgtgcagtcctgggtcctcctttctgagggcccgtgtaaatatgtacatttctcaggctagggccagcaggggctgcccgagtctgtttttcatgcgatgacacttgtacaattatcttttcaaaggtacttggataataatgaaataaaactgtttttgaacctgaataaaaaaaaaaaaaaaaaaaaaaaaaa

SEQ ID NO: 647 - DNA, 3140 bp, Homo sapiens
ggctgcgagtacctccatggtcccggtggctgtgacggcggcagtggcgcctgtcctgtccataaacagcgatttctcagatttgcgggaaattaaaaagcaactgctgcttattgcgggccttacccgggagcggggcctactacacagtagcaaatggtcggcggagttggctttctctctccctgcattgcctctggccgagctgcaaccgcctccgcctattacagaggaagatgcccaggatatggatgcctataccctggccaaggcctactttgacgttaaagagtatgatcgggcagcacatttcctgcatggctgcaatagcaagaaagcctattttctgtatatgtattccagatatctgtctggagaaaaaaagaaggacgatgaaacagttgatagcttaggccccctggaaaaaggacaagtgaaaaatgaggcgcttagagaattgagagtggagctcagcaaaaaacaccaagctcgagaacttgatggatttggactttatctgtatggtgtggtgcttcgaaaactggacttggttaaagaggccattgatgtgtttgtggaagctactcatgttttgcccttgcattggggagcctggttagaactctgtaacctgatcacagacaaagagatgctgaagttcctgtctttgccagacacctggatgaaagagttttttctggctcatatatacacagagttgcagttgatagaggaggccctgcaaaagtatcagaatctcattgatgtgggcttctctaagagctcgtatattgtttcccaaattgcagttgcctatcacaatatcagagatattgacaaagccctctccatttttaatgagctaaggaaacaagacccttacaggattgaaaatatggacacattctccaaccttctttatgtcaggagcatgaaatcggagttgagttatctggctcataacctctgtgagattgataaataccgtgtagaaacgtgctgtgtaattggcaattattacagtttacgttctcagcatgagaaagcagccttatatttccagagagccctgaaattaaatcctcggtatcttggtgcctggacactaatgggacatgagtacatggagatgaagaacacgtctgctgctatccaggcttatagacatgccattgaggtcaacaaacgggactacagagcttggtatggcctcgggcagacctatgaaatccttaagatgccattttactgcctttattattatagacgggcccaccagcttcgacccaatgattctcgcatgctggttgctttaggagaatgttacgagaaactcaatcaactagtggaagccaaaaagtgttattggagagcttacgccgtgggagatgtggagaaaatggctctggtgaaactggcaaagcttcatgaacagttgactgagtcagaacaggctgcccagtgttacatcaaatatatccaagatatctattcctgtggggaaatagtagaacacttggaggaaagcactgcctttcgctatctggcccagtactattttaagtgcaaactgtgggatgaagcttcaacttgtgcacaaaagtgttgtgcatttaatgatacccgggaagaaggtaaggccttactccggcaaatcctacagcttcggaaccaaggcgagactcctaccaccgaggtgcctgctccctttttcctacctgcttcactctctgctaacaatacccccacacgcagagtttctccactcaacttgtcttctgtcacgccatagttggctactctcaagccagcacattgttagacccatcttaattaagccttacctccatgtaaagaacagcacgtctgttccaaggacctcagctcttcttgtttctacagatggcaacagctccatagggacagcttgtataattaccttcagaggccaactgacagaatcctggcaggaacagacattatcttgccagttagaagtacttctgtctcacttatgtccaaagagtggctatagatcttggccttcttccctgaatgctttttttttttggcccccaagaaagtcccttttatagcactttagcacaggcaatgctacaggaacaaagtttcaatgctgctgagagtgaaagaaaggaggaaagtctgccactctaccctgagctggcagtagggcactgagtacccttaggaagaagtcagagcaatggatacaaatgaccttgctcttggatttgctgagcatgatccctattctgatgtcagagattaggtttaaatggaatagagctatccatttgttcttactctctagggagacaatcttccaaaacagttttgggggggtcttctaaagctttcaaattggaagtaactttattcaactagagttgaataaaagaagggcaaaaataatctcacagagcttggaactgctgatagcccttactgagggcaaaagatggctatattgttagctatactcctaccaaagcaagcaaggagataggattatagataatttcacggacatttggaaataacattggtgattatacagacaagaataaactcacttcaagctggtctgttttaataaattttcaacgtaattgtctatttttttccctcccatctgcaacagaatacatttttttcagcctttatctagatgaggtaaagggaatcattcttatggtgctcttggagagtttcaggcctgtgcatgtgtgtacagcaggaggtaatatgctataatgtctgctgtaatatatttgcacagtagatgctatggatcattctgagctcagggtccagactttattcttattcccagaattttgtgttacgtttttacctcctaacatatgacacttcatcttatattaaggaaggtttagaatatctaatacgacttgaattcatttgttactaagccttctcaggcaagctgtatactagttactggtctccactgccatgccttttcaaggttcccatggtccagaatgatgtttgattcttaatttttctgtcccttttataatttgttttaatgattttgctacatttggaattcaataaaaaatgtgaacaataataaaaaaaaaaaaaaaaaa

SEQ ID NO: 648 - DNA, 3513 bp, Homo sapiens
ccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcggctggaagctctactacagaactgccaggcagcttgtgccctgctccagggggccatcgaaagtgtgaaggctgtgccccagcccatggagcctggggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatagggtgcagtttgggatgtacgcgctctacagcaagaataagcctcgctccgatgccctgatgtcaagctatgggcacaccttcttcaaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaaggaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcctagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatttgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 649 - DNA, 3597 bp, Homo sapiens
catgccagttacttcctcaggaaaatattttcttgccttcttctttcagtatggttttaaatttgggaacagtggataacccaagtgtcccacaggccaaggtatattccaatggcagcatgatccctgcacccaaagccagcccctaaagcctaccccttgtgcacccgcagcctggtaagtgagcttggctgcttgtgaggagctacaagtgaaagagaagttattttaaataaatcccaaagtttgaggcagactgtccaggactgttcccaggaagaagcaggagttacccacaggaaaagtctctgacctggtcccctcaggcccagctacctgcgcccaccagcagtgaaggttgatgtactggcccagcatctccacctcccccatgcaaccaggtccctggtaccgtgtctcccgttgcatgtctggcttctgcctgtgctcctcctgccacgagcatcctccctgtccctcctcattccaccgtgtctctcctgcacacatagcctctgtcccagggcgatttatccacttgagtacaggagctgctcagacctctcagcccagccctctgtgactgccccagccccatcctaccccacccaaagctgccttcctggctgtaggagctccctcgtctagccaaggccctatgggtccccatccgaggatccacaagcaatgacttcccaaatgacctccactgcaagaagaatccttaccactgtttccagagccgtgaacgatgctgtgatggcccaggtctcagcaccaccctctgtgacctaaaaagaaaagctcaatttccatctgtcttctttcccaggaccaaggggacacagtaatgtgaagtcaaatacttaaccgagcaaagggccagtgttgttatcagtcaaggacaaacctcccacctcacagacagccaagcagtgagggaaagacagacagacataggtaggaaggtgctctgcaggcacaaggcccagagaagcccctctccgggaacttcccctgctccttccaggaacagtgagcccagtgagcagtcccagccagctcttcaaggccttcaaggggtctttccatgactgagtcacctccaggagctcacctgacccccagagaagacctaccccaggcagctccgtgccctggcttctccccatgccccaaatcccccccagccatccctcctggtcctcgtctacatcaagggcctcttcccctcttcctcccagctctcaggacaggtgactgggagaccttgaaccctcagcctcttcctttaaaaaaaacaaaacaaaacaaaactgtgggccatttatttgggattttggagttgtttggtttttgtttttatatcttaatagttcgaaagtaagaagggagccctgctatggatgttaagtccaaattactcggttagtgggagcaaaacctatgacttccaaggggatgaggagaggttcagaggacaggaggagcctcccccattgaaaaaaaaaaaatgggtcaggacattccctggatgaggacaatgctaggggtggcatctcacatggctgctgctattcctggtgcttccccacacttttgacagatggagtccttctcctaccgcctcctgccacctcaccctacaggcattctctatgtaggaaacaagagccttatcttatagagtggggagctgagacacagcctcaggtaacactgacacagctcccgaatgaggctgggacactctgcaaacctctcctcatggtgctaagggtggcatgctcttgacaggaaacctaaatgaccactcctctcatttggaaagtaatccactgcagtaaaagtttcagacatgcaagagagagtttttttttttttttactacaaatttttgctcccccataaaattatttttttattagagggagtatccaagttttaaaagtatatagaattttttggttgtaagagaaatacatactcattaggatcccgattaaattccttgagtagactggtgcctaccagaaagcaaagcaaagttaaacaaaacgaaacaaaatccttcatatacaaaaagaactttctgtttgtattggcagaggtagtgaggtgattcaggtaggctgaaaatcctgggttgcgggagcctcactttattccattcccacccgctttgatgtctatgcttggctctctgggctgcccctggtactgccgaatcctacacatctcttatcagctttcctcaaactttaaggaggctctgtgagggatgggtcatgggaagacccaagctttccctccgccaggattgcaaaagcaagtagacttggtctatgcagctcttcttccaacaatttctttatttggaattagaacttcctttgttagtatctttgatcttttgactcaagcacattttggaagggctcccttacaaaagtagaatttaaaacagaggatacagttaaagagcaacccaaaggacgcttaagaaaccgagaccacttcaccgaacaggactaaggaacactttcgtgcacagaagtcagccgcaatccaggcacaggacgaagatgggatacacgtgctcatctgtctgtcctcctttcctctccctccccgacgttctagttagcttgttgacttgttaaaccttctgttcttaaaatgaaaagctagcttacctcaaagaatcttgtttccattcggaaaccaacgattttgtgttttagaatggacagccctcccctcaccactccctaccttggcctggtgtccttgagacatacggtctttgcttagtcgtgtgttggctgctttgagcaggaacgaggcctccaggccctgaggtgggaaggaaggattggatgccactgccctcctccccactttagcatgtaggggccagcccatctcttccagcagggtcctgctgagttaccatagcaaccagcaactccagggtaccacaacagacaatggctcagcgagccgacgtgtggggatgatgcaggggttttggcccagccagaggacccagagttgagcttcaaatgctagagaaggggagaaacaggatggaagggtggtttaaggaactggcaggggtctttgagtcacatagagaagccgttgaaggaggtagggcaggttatctctgttccagtcacccccttccagccccatcccacttctgtttcaaactaaagctcccacctcgaacattgaccctttgttagaacaaagcaaagcatatctttaaacaacagtgttaaaatgagcctcaaatgtatgtggatgagatctctaagaagagggtcttctggttttgatttttaaagaagagtatcctagtaaaatattaaaaaaaaattaaaaagtttttaaaaaggaaacctatgctatttaaattggagcccagttgtaacttggtaaaggcaagcttctgtacctttgttataattaattgtatacctgtgtatgtaaatataaggcattcctattttgcagttcagaacaaaaaaaacttatttgtaatatagaataaagtttattaaaaaataagaaaaaaaaaaaaaaaaaaaa

SEQ ID NO: 650 - DNA, 855 bp, Homo sapiens
cgctcaattatctactcgagtctagactcgaggcggccgcccattgtgcactaaagcaggggatagcaacggcgtccctcctccccgctcagctgcagcccgcagtcctcacagtggtaacatgccacgtggtagtctctgtccatggacaccacacggatggttgtctcgcagccctgtgcagggaggataggacgggcacaggaggcgcattttggtgcaaaaaccgtgtgatagtctcgcacgcagtagatgttgttctccacgtccacggtgaagggaaccccgtccaggcactcattgcacacggagcaccggaagcagcctgggtggtaggacttgcccagggcctgcaggatcatttccatgatgagatgtccacacacgctgcatttgtcggccgtctgctggaacccggagtacaggaagtcctcctggcagtacactttctcacccacgttgtagaacgccttcccacggagtcgtctcccacacgagtcgcaggtgaagcagtcagtgtgataaagactccccattgcctggcacgcctgctgggctccgtagatgccaagcccacacttgatgcaaatgccgaagtagtcccgcgccgtgcgcgcctcgagcgcccgctccagctcccgggtgagcgcctccagccgccgctcggccgcgcttgggccgccctcccggccagggggcagcgggagtgcaggcagcgggaagggggccggccccgcaggctccggggagcgagcgggcgcggggcaggcgccgggcgggaggaagtcagcgtaggctttagtgcacaatgggaattcggatccggtcgacactagttctaggatctcttttttt

SEQ ID NO: 651 - DNA, 3791 bp, Homo sapiens
acagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccacctctggaaaaagatcccccgcttgctcctcgctgaccccatcactgtgcaagctggggctgcaggaaggcagcaacaactcgtctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattgtggagtttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgaatcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacattcgtctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatgcgtaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagaatgagaagatcctagaacagatagacaagagtggcgagctcataagccttagagaggaggtgacccaccttacccgctcacttcggcgtgcggagacagagaccaaagtgctccaggaggcctggcaggccagctggactccaactgccagcctatggccaccaattggatccaggagaaagtgtggctctctcaggaggtggacaaactgagagtgatgttcctggagatgaaaaatgagaaggaaaactcctgatcaagttccagagcccatagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatttgtttcacctctttttacctgcaatacccccttaccccaataccaagaccaactggcatagagccaactgagataaatgctatttaaataaagtgtatttaatgaaaaaaaaaaaaaaaaaaaaa

SEQ ID NO: 652 - DNA, 1683 bp, Homo sapiens
ctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggcctgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcagtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatg

SEQ ID NO: 653 - DNA, 1696 bp, Homo sapiens
cacctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctgtggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgag

SEQ ID NO: 654 - DNA, 7680 bp, Homo sapiens
gaagagcaagaggcaggctcagcaaatggttcagccccagtccccggtggctgtcagtcaaagcaagcccggttgttatgacaatggaaaacactatcagataaatcaacagtgggagcggacctacctaggtaatgtgttggtttgtacttgttatggaggaagccgaggttttaactgcgaaagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggttgaagacacaaggaaataagcaaatgctttgcacgtgcctgggcaacggagtcagctgccaagagacagctgtaacccagacttacggtggcaacttaaatggagagccatgtgtcttaccattcacctacaatggcaggacgttctactcctgcaccacggaagggcgacaggacggacatctttggtgcagcacaacttcgaattatgagcaggaccagaaatactctttctgcacagaccacactgttttggttcagactcaaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcaacttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggccagcccaggcagtacaatgtgggtccctctgtctccaagtaccccctgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccatcgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaca

SEQ ID NO: 655 - DNA, 1316 bp, Homo sapiens
tcctaatacgactcactatagggctcgagcggccgcccgggcaggtcgaatgcaggcgacttgcgagctgggagcgatttaaaacgctttggattcccccggcctgggtggggagagcgagctgggtgccccctagattccccgcccccgcacctcatgagccgaccctcggctccatggagcccggcaattatgccaccttggatggagccaaggatatcgaaggcttgctgggagcgggaggggggcggaatctggtcgcccactcccctctgaccagccacccagcggcgcctacgctgatgcctgctgtcaactatgcccccttggatctgccaggctcggcggagccgccaaagcaatgccacccatgccctggggtgccccaggggacgtccccagctcccgtgccttatggttactttggaggcgggtactactcctgccgagtgtcccggagctcgctgaaaccctgtgcccaggcagccaccctggccgcgtaccccgcggagactcccacggccggggaagagtaccccagtcgccccactgagtttgccttctatccgggatatccgggaacctaccacgctatggccagttacctggacgtgtctgtggtgcagactctgggtgctcctggagaaccgcgacatgactccctgttgcctgtggacagttaccagtcttgggctctcgctggtggctggaacagccagatgtgttgccagggagaacagaacccaccaggtcccttttggaaggcagcatttgcagactccagcgggcagcaccctcctgacgcctgcgcctttcgtcgcggccgcaagaaacgcattccgtacagcaaggggcagttgcgggagctggagcgggagtatgcggctaacaagttcatcaccaaggacaagaggcgcaagatctcggcagccaccagcctctcggagcgccagattaccatctggtttcagaaccgccgggtcaaagagaagaaggttctcgccaaggtgaagaacagcgctaccccttaagagatctccttgcctgggtgggaggagcgaaagtgggggtgtcctggggagaccagaaacctgccaagcccaggctggggccaaggactctgctgagaggcccctagagacaacacccttcccaggccactggctgctggactgttcctcaggagcggcctgggtacccagtatgtgcagggagacggaaccccatgtgacaggcccactccaccagggttcccaaagaacctggcccagtcataatcattcatcctcacagtggcaataatcacgataaccagt

SEQ ID NO: 656 - DNA, 566 bp, Homo sapiens
cccaccaaacccataaagagggtgggtcgacccacgcgtccgcggacgcgtgggaaattattgaattggaaacagaaatagaaaagtttaaagctgagaacgcatctttagctaaacttcgcattgaacgagaaagtgccttggaaaaactcaggaaagaaattgcagacttcgaacaacagaaagcaaaagaattagctcgaatagaagagtttaaaaaggaggagatgaggaagctacaaaaggaacgtaaagtttttgaaaagtatactacagctgcaagaacttttccagataaaaaggaacgtgaagaaatacagactttaaaacagcaaatagcagatttacgggaagatttgaaaagaaaggagaccaaatggtcaagtacacacagccgtctcagaagccagatacaaatgttagtcagagagaacacagacctccgggaagaaataaaagtgatggaaagattccgactggatgcctggaagagagcagaagccatagagagcagcctcgaggtggagaagaaggacaagcttgcgaacacatctgttcgatttcaa

SEQ ID NO: 657 - DNA, 5067 bp, Homo sapiens
gcccggacacctgtctgcagcatggataagtatgacgacctgggcctggaggccagtaaattcatcgaggacctgaacatgtatgaggcctctaaggatgggctcttccgagtggacaagggtgcaggcaacaaccccgagtttgaggaaactcgcagggtgttcgccaccaagatggccaaaatccacctccagcagcagcagcagcagctcctgcaggaggagactctgcccagggggagtagaggccctgtcaatggagggggccgcctgggcccacaggcccgttgggaagttgtgggcagcaagctgactgtggatggtgctgccaagcctcctcttgctgcctcgacaggggcacctggggcagtcaccaccctcgctgctgggcagcccccgtacccaccgcaggagcagagatccaggccatacctgcatggcacgaggcatggcagccaggactgtggttccagggagagcctggcgacttctgagatgtctgctttccaccagccaggcccctgtgaggatccttcctgcctcactcatggagactattatgacaacctctccttggcaagcccaaagtggggtgacaaaccaggagtgtcccccagcatcggcctgagtgtagggagtgggtggcctagctccccggggagtgacccaccactgcccaaaccctgcggggaccatcccctaaatcaccgacagctctccctgagctccagcaggtcttctgagggtagcctcggtggtcagaatagtggcattggtggccgcagcagcgagaagccaacaggcctttggtccactgcctcctcccagcgggtgagccctggcctgccttccccaaacttggagaacggagcaccagctgtggggcctgttcagcccaggactccttctgtgtcagcacccttggccctgagctgccccaggcaaggaggtcttccaagatcaaactcggggctggggggtgaggtttcaggtgtgatgtccaaacccaatgtggacccccaaccctggttccaggatgggcccaaatcttacctttccagttctgccccgtcatcctcgccagctggcctggacggttcacagcagggtgcggtccctgggctggggccgaagcctggctgcacagaccttggcactggtcccaagctcagccccaccagtcttgtccatccagtgatgtccaccctgcctgagttatcttgtaaagagggtcccctgggctggtcttctgatggtagcctgggatctgtgctcctggacagccccagctcccctagggtaaggctgccctgccagcccctcgtcccaggtcctgagctgagaccctctgctgctgagttgaaattagaagccctcacccaacgtctggagcgagagatggatgctcacccgaaggctgattactttggagcctgtgtgaaatgcagcaaaggggtgtttggggctggccaggcctgtcaggccatggggaacctctaccatgacacatgcttcacctgtgcagcttgcagccggaagctgagaggaaaagccttttattttgtcaacggcaaagtgttttgtgaagaagacttcctgtactctggtttccagcagtcggctgacaggtgttttctttgtggacatctgatcatggacatgatcctgcaagccctggggaagtcctaccaccccggctgtttccgctgtgtcatctgtaatgagtgtttggatggggtgcccttcaccgtggactcagagaacaagatctactgtgtccgagattaccacaaggtgctggcccccaagtgtgcagcctgtgggcttcccatccttccacctgagggctcagatgagaccatccgtgtcgtgtccatggacagagactaccacgtggagtgttaccactgcgaggactgtggtctggagctcaatgatgaagatggccaccgctgttatccgctggaggaccacctgttctgtcactcctgccacgtgaagaggctggagaagagaccctcatctacagcccttcaccagcaccacttctagccagagccacttgcagacatcacggcaggggatgaggagccggggttgctgctgctgcttccggtggcccctggggtggaagtggggtaggggaagaggaggggcaggagggagagttcctgtgagcatgtggggggtgcctttcctttaaccagggaggtgaacactacctgcctcctgcgtgtattttccaagtgcttttctctgttgccacattttcctcaggttactcaggaaaatgctccagcatgtgcgagcacatgacctgaggttgcatcatagcaccaaaggaatcctcctgtcccctctgggaacatttcatgcttcagagggagaggtttttattgagcttgtttcacaatatccccttgaagggacagctcagctgccaatacattcaaccctttctcttccttcaggaaaatacctatacccaaatgttccctcccccgacatatatcatggcatgacttaaggcttcttttcacctgagagcttcagttcttctgcagaatggctgcaaatttaattgcattaaggcaagaaggaagctctaatgtgtgctttgtatcctaagataaatttgcttagaaaaccagagtcaagatttgaaataggtgaggcagggtttcctccttagacactgacagcattctccgtaccccttcaaatccttactctcctaaaggcagctgagtccgcgacagaaatttgccctatgggagtaaaacatactttgggagaagaacttggtgcaggcaccaggatttttttttttgcccacgtgtttgcgctgtttttctctggagttctcaagagttggtgacttggaaggccgcttctgcaaggcaagtctcaggaacccatgcaggtacatcgcttgcacctgtttttagcttatttaatgacgggcttttgggaagagctgcccgcatactgagagacagcttcttataaacaaggagagtttttgtgtgtgcgagatctctaagccagcgtgggagggagcgcctcaggataagttattatattcatttcgttggtttctctcctgcccaattcttggcacaggcattatgtttgaagaaaccaggataaggtacactgcttttgtctgtttaatttttttagttgtttcccttcactttcagtcttccacacacaaaaaatacctcacagagcttcaccaaatcacagattcaggaggaatttggctttcacactggactcagataccttcttcagtgtgttggaaatcactggcttcacacaggcccaactccaactggtcagggcagagtgatcgtaactaaaggtcagtggggaatagatccgattcagtgcttttgccttatgcatttcagcatcctggctccccagggtggcaggagctgaggaagggccacacactggcaagatttcaagaccactctctgcactgaagaggtaaaatttgcactgcaagtcacatccctgaggccagaggtcagtaccctttggtatttcgattagaagaagctgcaaaagaaaggcagcccattttaccattgccagccaggccggggacacaggagccggtgtgtgcactctgcctcctaacattgcacccagagcaagaggactgggtgctgggctgcagaggccggtcagtggagcccctagcacgtgtgaactcaggcttttcattgggcccggctccacttctaggccatgttttgactcatttggtaaccattgcctgtaagcagcacagaattggtgccatggattatcttttccatgttgatggaattcattctgttggaatcctttggccagatgtcacttcagccagggtgtgcatcatcattggttctttttcacaggctgagcctcctgaaaacccatgaacgctggggctggggaagtgaaccctgaggtggggaccctctcttcccatcaaatcatccagctcagtgtggggcgtggcaggggggtaaatgaagccagccaatgtgttaacctgtctctgtcaacctaagaatgttggccttactgacacacctttgctccatgttcaagaccagaagtagctgggatttgtttgcaaattgggtaattagtttaaaaatctgtgattacatttttaaatgaaattttcaaagtggcctagattgaggtgattcagataggtttgcgaatataccattttatattgttgagaaagaacaaaaagggaatttccagatgtcctagaaatcctagcaacagatttctctggttgtcagtttccctggagaaggcgccagataggaatctccaatcagttgtttttctcttcgcttcaggcccttacacaaaagccatgaagagatgttcacctacccggtattttaaatgttctgtaaattattagccaaatagaactgtaatggggttgtatttatgggcgcctagaaagaaaacacaaggacttggtaggccaggaagaaaagattttaaaatttagaatgaatagcccttctgggttttctttttgacaattcttggacttgaggtaaaacaaggaggattgtggccggatttcagatcccaaagccagcctccatcttaggcctttgcctcattgtgccttttaggttttcttacccaccgtctcctgttttgtcttttttttcttttctcctacccctatcttgggacattcagaaactgcctgggtggtttgagaagagacaacccagtttgatctgcaatacaaggatccattcgtaatctctctctcactgatgttattcccccatctgccgtcttggttcatctcaccacagaagggcatttagtcctacccagccatcggctgcggtatgacagcaggatggcacttcccatttctctgtggttagtgctcgagtgaaaacctctttcagctgagtcctctgaggttctgctgttgagtcctgggtggctgatggaatgattgaggaggtctggtcaccctcaagcgccgtcatcgccttgtttccatgggcttct

SEQ ID NO: 658 - DNA, 950 bp, Homo sapiens
tcgaccggatccgaattcccattgtgcactaaagcgtctccctgctccgcggcccgggctggcgggcgggcgctcggctggcggctgcagcagcagagggagacccgcggcaaccccggcaacccagggctcggcgtcgctgccaccatgacgggaagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgttcccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagctttagtgcacaatgggcggccgcctcgagtctagactcgagtagataattgagcggaatttctt

SEQ ID NO: 659 - DNA, 2346 bp, Homo sapiens
ccgccgtcgcccccgcctccccctgcctcagcggctgcccccgccagcgggccgcccgctcccccgggccttgcagcgggccccggcccggctggaggggccccgaccccagctctggtggcgggcagcagcgccgcggcccccttccctcacggggactcggccctgaacgagcaggagaaggagttgcagcggcggctgaagcgtctctacccggccgtggacgaacaagagacgccgctgcctcggtcctggagcccgaaggacaagttcagctacatcggcctctctcagaacaacctgcgggtgcactacaaaggtcatggcaaaaccccaaaagatgccgcgtcagttcgagccacgcatccaataccagcagcctgtgggatttattattttgaagtaaaaattgtcagtaagggaagagatggttacatgggaattggtctttctgctcaaggtgtgaacatgaatagactaccaggttgggataagcattcatatggttaccatggggatgatggacattcgttttgttcttctggaactggacaaccttatggaccaactttcactactggtgatgtcattggctgttgtgttaatcttatcaacaatacctgcttttacaccaagaatggacatagtttaggtattgctttcactgacctaccgccaaatttgtatcctactgtggggcttcaaacaccaggagaagtggtcgatgccaattttgggcaacatcctttcgtgtttgatatagaagactatatgcgggagtggagaaccaaaatccaggcacagatagatcgatttcctatcggagatcgagaaggagaatggcagaccatgatacaaaaaatggtttcatcttatttagtccaccatgggtactgtgccacagcagaggcctttgccagatctacagaccagaccgttctagaagaattagcttccattaagaatagacaaagaattcagaaattggtattagcaggaagaatgggagaagccattgaaacaacacaacagttatacccaagtttacttgaaagaaatcctaatctccttttcacattaaaagtgcgtcagtttatagaaatggtgaatggtacagatagtgaagtacgatgtttgggaggccgaagtccaaagtctcaagacagttatcctgttagtcctcgaccttttagtagtccaagtatgagccccagccatggaatgaatatccacaatttagcatcaggcaaaggaagcaccgcacatttttcaggttttgaaagttgtagtaatggtgtaatatcaaataaagcacatcaatcatattgccatagtaataaacaccagtcatccaacttgaatgtaccagaactaaacagtataaatatgtcaagatcacagcaagttaataacttcaccagtaatgatgtagacatggaaacagatcactactccaatggagttggagaaacttcatccaatggtttcctaaatggtagctctaaacatgaccacgaaatggaagattgtgacaccgaaatggaagttgattcaagtcagttgagacgccagttgtgtggaggaagtcaggccgccatagaaagaatgatccactttggacgagagctgcaagcaatgagtgaacagctaaggagagactgtggcaagaacactgcaaacaaaaaaatgttgaaggatgcattcagtctactagcatattcagatccctggaacagcccagttggaaatcagcttgacccgattcagagagaacctgtgtgctcagctcttaacagtgcaatattagaaacccacaatctgccaaagcaacctccacttgccctagcaatgggacaggccacacaatgtctaggactgatggctcgatcaggaattggatcctgcgcatttgccacagtggaagactacctacattagctatgcatttcaagagctcacacttatattgtggcatatagtcaacatggaagtagaccagctctgctgatttgaaatttagattttttaaattatgtactggggacaggtttttgtcgctttacattgcttcctagtttacagcatgatgcaaatgattttctaacttagtgttaggagaaattattttccatctttaacctcttagttgtctaagagttaaatattactgaatttcagacgttcaaattgatcatcacaaatcctttaaaacaattacctaaaagaaaccaaaaatcctgccttctttgtgggggaggggggagagaggggaaggaaatggaacaagttgtgtttgtgttagcatgtgggtgatgtaaacttcaaattgggagatgttccgacccc

SEQ ID NO: 660 - DNA, 2512 bp, Homo sapiens
caatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataacaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggggatctgccatatttgtgttggtttttattttcatatccagcctaaaggtggttgtttattatatagtaataaatcattgctgtacaacatgctggtttctgtagggtatttttaattttgtcagaaattttagattgtgaatattttgtaaaaaacagtaagcaaaattttccagaattcccaaaatgaaccagataccccctagaaaattatactattgagaaatctatggggaggatatgagaaaataaattccttctaaaccacattggaactgacctgaagaagcaaactcggaaaatataataacatccctgaattcaggcattcacaagatgcagaacaaaatggataaaaggtatttcactggagaagttttaatttctaagtaaaatttaaatcctaacacttcactaatttataactaaaatttctcatcttcgtacttgatgctcacagaggaagaaaatgatgatggtttttattcctggcatccagagtgacagtgaacttaagcaaattaccctcctacccaattctatggaatattttatacgtctccttgtttaaaatctgactgctttactttgatgtatcatatttttaaataaaaataaatattcctttagaagatcactctaaaa

SEQ ID NO: 661 - DNA, 2306 bp, Homo sapiens
gggcgggagctgcacgcgccgtggctccggatctcttcgtctttgcagcgtacgcccgagtcggtcagcgccggaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgacccctacctctaccggcccgttgctgtggctctagacactaaaggacctgagatccgaactgggctcatcaagggcagcggcactgcagagctggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacc

SEQ ID NO: 662 - DNA, 2656 bp, Homo sapiens
gaattcgcggccgcagagtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagccttacaggaacaaaacataaccctttcatttgtactgcctccttccacacgagtgcccctttggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggaacagccagagcccagggcctgtacgagacgatcaacgtgacgatcccccctgggactcagacagaccagaagattcggatgggtgggaaaggcatcccccggattaacagctacggctacggagaccactacatccacatcaagatacgagttccaaagaggctaacgagccggcagcagagcctgatcctgagctacgccgaggacgagacagatgtggaggggacggtgaacggcgtcaccctcaccagctctggtggcagcaccatggatagctccgcaggaagcaaggctaggcgtgaggctggggaggacgaggagggattcctttccaaacttaagaaaatgtttacctcatgatatcccagccgaggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggccccctggtcagcagaggagaggttagatcttgcaggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaagcacgttaaaggcccagagagatcctgggggttctgctctgaccgtgtgggtggtgatccttgtcaggatgtacagtccttgctcccaccccatccgggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgaaaaaaaaaaaaaaaaa

SEQ ID NO: 663 - DNA, 2217 bp, Homo sapiens
gcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 664 - DNA, 8906 bp, Homo sapiens
gaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcacgtgagaacaatctggcaacaccgcaaggtccggctgcatcagaggctgcagctgtgtgttttccagcaggaagttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcacgtgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaaatatcagctccttttaaaagagctgctgacgtgctgtgaggaaggaaagggagagattaaagatggcctggaggtgatgctcagcgtgccgaagcgagccaatgacgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggaccactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcagagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcatcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgccaaggacggaggtcgcattgctgtatcacagtattttttacggatttctg

SEQ ID NO: 665 - DNA, 1204 bp, Homo sapiens
tcggcggcggtggtatcggcggcagctgtgagggggttccgggaagatggtgctgatcaaggaattccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagtcaagaccaagagaggccctttgggacccaactggaagaaggagctggcaaacagccctgactgtccccagatgtgtgcctataagctggtgaccatcaaattcaagtggtggggactgcaaagcaaagtagaaaacttcattcaaaagcaagaaaaacggatatttacaaacttccatcgccagcttttttgttggattgacaagtggatcgatctcacgatggaagacattaggagaatggaagacgagactcagaaagaactagaaacaatgcgtaagaggggttccgttcgaggcacgtcggctgctgatgtctagatgagtcccctgtagggtcagagacaatgtcaaactgtttacgtaatcaaggtcaagtgaggggaacaagcgcagccagtgatgagtgaacaacaatctgaccagtatcttgcagtgttgacgtttcccagatgtgtgcttgtgatgatacacacacatgcacaggttctcaaccacgtgtgtatatatgtatgtgtgcatatgtctgtagctgtatataaagcgcatgtagagctacagatccagatacacacacttgtgtatatatgtacatacagacatactgaagggattagtacaatttctccaaagtactgtacctatcttcagcaagaatgcaaa

SEQ ID NO: 666 - protein, 892 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 667 - protein, 197 aa, Homo sapiens
MMFPQSRHSGSSHLPQQLKFTTSDSCDRIKDEFQLLQAQYHSLKLECDKLASEKSEMQRHYVMYYEMSYGLNIEMHKQAEIVKRLNGICAQVLPYLSQEHQQQVLGAIERAKQVTAPELNSIIRQQLQAHQLSQLQALALPLTPLPVGLQPPSLPAVSAGTGLLSLSALGSQAHLSKEDKNGHDGDTHQEDDGEKSD

SEQ ID NO: 668 - protein, 739 aa, Homo sapiens
GDKEPTETIGDLSICLDGLQLESEVVTNGETTCSESASQNDDGSRSKDETRVSTNGSDDPEDAGAGENRRVSGNNSPSLSNGGFKPSRPPRPSRPPPPTPRRPASVNGSPSATSESDGSSTGSLPPTNTNTNTSEGATSGLIIPLTISGGSGPRPLNPVTQAPLPPGWEQRVDQHGRVYYVDHVEKRTTWDRPEPLPPGWERRVDNMGRIYYVDHFTRTTTWQRPTLESVRNYEQWQLQRSQLQGAMQQFNQRFIYGNQDLFATSQSKEFDPLGPLPPGWEKRTDSNGRVYFVNHNTRITQWEDPRSQGQLNEKPLPEGWEMRFTVDGIPYFVDHNRRTTTYIDPRTGKSALDNGPQIAYVRDFKAKVQYFRFWCQQLAMPQHIKITVTRKTLFEDSFQQIMSFSPQDLRRRLWVIFPGEEGLDYGGVAREWFFLLSHEVLNPMYCLFEYAGKDNYCLQINPASYINPDHLKYFRFIGRFIAMALFHGKFIDTGFSLPFYKRILNKPVGLKDLESIDPEFYNSLIWVKENNIEECDLEMYFSVDKEILGEIKSHDLKPNGGNILVTEENKEEYIRMVAEWRLSRGVEEQTQAFFEGFNEILPQQYLQYFDAKELEVLLCGMQEIDLNDWQRHAIYRHYARTSKQIMWFWQFVKEIDNEKRMRLLQFVTGTCRLPVGGFADLMGSNGPQKFCIEKVGKENWLPRSHTCFNRLDLPPYKSYEQLKEKLLFAIEETEGFGQE

SEQ ID NO: 669 - protein, 431 aa, Homo sapiens
GPPPTRALPLPQSLPPDFRLEPTAPALSPRSSFASSSASDASKPSSPRGSLLLDGAGAGGAGGSRPCSNRTSGISMGYDQRHGSPLPAGPCLFGPPLAGAPAGYSPGGVPSAYPELHAALDRLYAQRPAGFGCQESRHSYPPALGSPGALAGARVGAAGPLERRGAQPGRHSVTGYGDCAVGARYQDELTALLRLTVGTGGREAGARGEPSGIEPSGLEEPPGPFVPEAARARMREPEAREDYFGTCIKCNKGIYGQSNACQALDSLYHTQCFVCCSCGRTLRCKAFYSVNGSVYCEEDYLFSGFQEAAEKCCVCGHLILEKILQAMGKSYHPGCFRCIVCNKCLDGIPFTVDFSNQVYCVTDYHKNYAPKCAACGQPILPSEGCEDIVRVISMDRDYHFECYHCEDCRMQLSDEEGCCCFPLDGHLLCHG

SEQ ID NO: 670 - protein, 900 aa, Homo sapiens
GPGSRHHRARDRLIHFGAVSTDVLGCSAHCSLTQSPKMNIQEQGFPLDLGASFTEDAPRPPVPGEEGELVSTDPRPASYSFCSGKGVGIKGETSTATPRRSDLDLGYEPEGSASPTPPYLKWAESLHSLLDDQDGISLFRTFLKQEGCADLLDFWFACTGFRKLEPCDSNEEKRLKLARAIYRKYILDNNGIVSRQTKPATKSFIKGCIMKQLIDPAMFDQAQTEIQATMEENTYPSFLKSDIYLEYTRTGSESPKVCSDQSSGSGTGKGISGYLPTLNEDEEWKCDQDMDEDDGRDAAPPGRLPQKLLLETAAPRVSSSRRYSEGREFRYGSWREPVNPYYVNAGYALAPATSANDSEQQSLSSDADTLSLTDSSVDGIPPYRIRKQHRREMQESAQVNGRVPLPHIPRTYRVPKEVRVEPQKFAEELIHRLEAVQRTREAEEKLEERLKRVRMEEEGEDGDPSSGPPGPCHKLPPAPAWHHFPPRLCWTWACAGLRDAHEENPESILDEHVQRVLRTTGRQSPGPGHRSPDSGHVAKMPVALGGAASGHGKHVPKSGAKLDAAGLHHHRHVHHHVHHSTARPKEQVEAEATRRAQSSFAWGLEPHSHGARSRGYSESVGAAPNASDGLAHSGKVGVACKRNAKKAESGKSASTEVPGASEDAEKNQKIMQWIIEGEKEISRHRRTGHGSSGTRKPQPHENSRPLSLEHPWAGPQLRTSVQPSHLFIQDPTMPPHPAPNPLTQLEEARRRLEEEEKRASRAPSKQRYVQEVMRRGRACVRPACAPVLHVVPAVSDMELSETETRSQRKVGGGSAQPCDSIVVAYYFCGEPIPYRTLVRGRAVTLGQFKELLTKKGSYRYYFKKVSDEFDCGVVFEEVREDEAVLPVFEEKIIGKVEKVD

SEQ ID NO: 671 - protein, 591 aa, Homo sapiens
MVPVAVTAAVAPVLSINSDFSDLREIKKQLLLIAGLTRERGLLHSSKWSAELAFSLPALPLAELQPPPPITEEDAQDMDAYTLAKAYFDVKEYDRAAHFLHGCNSKKAYFLYMYSRYLSGEKKKDDETVDSLGPLEKGQVKNEALRELRVELSKKHQARELDGFGLYLYGVVLRKLDLVKEAIDVFVEATHVLPLHWGAWLELCNLITDKEMLKFLSLPDTWMKEFFLAHIYTELQLIEEALQKYQNLIDVGFSKSSYIVSQIAVAYHNIRDIDKALSIFNELRKQDPYRIENMDTFSNLLYVRSMKSELSYLAHNLCEIDKYRVETCCVIGNYYSLRSQHEKAALYFQRALKLNPRYLGAWTLMGHEYMEMKNTSAAIQAYRHAIEVNKRDYRAWYGLGQTYEILKMPFYCLYYYRRAHQLRPNDSRMLVALGECYEKLNQLVEAKKCYWRAYAVGDVEKMALVKLAKLHEQLTESEQAAQCYIKYIQDIYSCGEIVEHLEESTAFRYLAQYYFKCKLWDEASTCAQKCCAFNDTREEGKALLRQILQLRNQGETPTTEVPAPFFLPASLSANNTPTRRVSPLNLSSVTP

SEQ ID NO: 672 - protein, 914 aa, Homo sapiens
VYQVLLVGSTLLKEVPSGLQLEQLPSQSLLTHIPTAGLPTSLGGGLPYCHQAWLDFRRRLEALLQNCQAACALLQGAIESVKAVPQPMEPGEVGQLLQQTEVLMQQVLDSPWLAWLQCQGGRELTWLKQEVPEVTLSPDYRTAMDKADELYDRVDGLLHQLTLQSNQRIQALELVQTLEARESGLHQIEVWLQQVGWPALEEAGEPSLDMLLQAQGSFQELYQVAQEQVRQGEKFLQPLTGWEAAELDPPGARFLALRAQLTEFSRALAQRCQRLADAERLFQLFREALTWAEEGQRVLAELEQERPGVVLQQLQLHWTRHPDLPPAHFRKMWALATGLGSEAIRQECRWAWARCQDTWLALDQKLEASLKLPPVGSTASLCVSQVPAAPAHPPLRKAYSFDRNLGQSLSEPACHCHHAATIAACRRPEAGGGALPQASPTVPPPGSSDPRSLNRLQLVLAEMVATEREYVRALEYTMENYFPELDRPDVPQGLRGQRAHLFGNLEKLRDFHCHFFLRELEACTRHPPRVAYAFLRHRVQFGMYALYSKNKPRSDALMSSYGHTFFKDKQQALGDHLDLASYLLKPIQRMGKYALLLQELARACGGPTQELSALREAQSLVHFQLRHGNDLLAMDAIQGCDVNLKEQGQLVRQDEFVVRTGRHKSVRRIFLFEELLLFSKPRHGPTGVDTFAYKRSFKMADLGLTECCGNSNLRFEIWFRRRKARDTFVLQASSLAIKQAWTADISHLLWRQAVHNKEVRMAEMVSMGVGNKAFRDIAPSEEAINDRTVNYVLKCREVRSRASIAVAPFDHDSLYLGASNSLPGDPASCSVLGSLNLHLYRDPALLGLRCPLYPSFLEEAALEAEAELGGQPSLTAEDSEISSQCPSASGSSGSDSSCVSGQALGRGLEDLPCV

SEQ ID NO: 673 - protein, 277 aa, Homo sapiens [sequence omitted]

SEQ ID NO: 674 - protein, 1120 aa, Homo sapiens
MWRVKKLSLSLSPSPQTGKPSMRTPLRELTLQPGALTTSGKRSPACSSLTPSLCKLGLQEGSNNSSPVDFVNNKRTDLSSEHFSHSSKWLETCQHESDEQPLDPIPQISSTPKTSEEAVDPLGNYMVKTIVLVPSPLGQQQDMIFEARLDTMAETNSISLNGPLRTDDLVREEVAPCMGDRFSEVAAVSEKPIFQESPSHLLEESPPNPCSEQLHCSKESLSSRTEAVREDLVPSESNAFLPSSVLWLSPSTALAADFRVNHVDPEEEIVEHGAMEEREMRFPTHPKESETEDQALVSSVEDILSTCLTPNLVEMESQEAPGPAVEDVGRILGSDTESWMSPLAWLEKGVNTSVMLENLRQSLSLPSMLRDAAIGTTPFSTCSVGTWFTPSAPQEKSTNTSQTGLVGTKHSTSETEQLLCGRPPDLTALSRHDLEDNLLSSLVIVEFLSRQLRDWKSQLAVPHPETQDSSTQTDTSHSGITNKLQHLKESHEMGQALQQARNVMQSWVLISKELISLLHLSLLHLEEDKTTVNQESRRAETLVCCCFDLLKKLRAKLQSLKAEREEARHREEMALRGKDAAEIVLEAFCAHASQRISQLEQDLASMREFRGLLKDAQTQLVGLHAKQEELVQQTVSLTSTLQQDWRSMQLDYTTWTALLSRSRQLTEKLTVKSQQALQERDVAIEEKQEVSRVLEQVSAQLEECKGQTEQLELENIRLATDLRAQLQILANMDSQLKELQSQHTHCAQDLAMKDELLCQLTQSNEEQAAQCVKEEMALKHMQAELQQQQAVLAKEVRDLKETLEFADQENQVAHLELGQVECQLKTTLEVLRERSLQCENLKDTVENLTAKLASTIADNQEQDLEKTRQYSQKLGLLTEQLQSLTLFLQTKLKEKTEQETLLLSTACPPTQEHPLPNDRTFLGSILTAVADEEPESTPVPLLGSDKSAFTRVASMVSLQPAETPGMEESLAEMSIMTTELQSLCSLLQESKEEAIRTLQRKICELQARLQAQEEQHQEVQKAKEADIEKLNQALCLRYKNEKELQEVIQQNEKILEQIDKSGELISLREEVTHLTRSLRRAETETKVLQEAWQASWTPTASLWPPIGSRRKCGSLRRWTN

SEQ ID NO: 675 - protein, 540 aa, Homo sapiens
MGTTARAALVLTYLAVASAASEGGFTATGQRQLRPEHFQEVGYAAPPSPPLSRSLPMDHPDSSQHGPPFEGQSQVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEEAMSRFCEAEFSVKTRPHWCCTRQGEARFSCFQEEAPQPHYQLRACPSHQPDISSGLELPFPPGVPTLDNIKNICHLRRFRSVPRNLPATDPLQRELLALIQLEREFQRCCRQGNNHTCTWKAWEDTLDKYCDREYAVKTHHHLCCRHPPSPTRDECFARRAPYPNYDRDILTIDISRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 676 - protein, 462 aa, Homo sapiens [sequence omitted]

SEQ ID NO: 677 - protein, 2328 aa, Homo sapiens
KSKRQAQQMVQPQSPVAVSQSKPGCYDNGKHYQINQQWERTYLGNVLVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNLNGEPCVLPFTYNGRTFYSCTTEGRQDGHLWCSTTSNYEQDQKYSFCTDHTVLVQTQGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 678 - protein, 188 aa, Homo sapiens
HQTHKEGGSTHASADAWEIIELETEIEKFKAENASLAKLRIERESALEKLRKEIADFEQQKAKELARIEEFKKEEMRKLQKERKVFEKYTTAARTFPDKKEREEIQTLKQQIADLREDLKRKETKWSSTHSRLRSQIQMLVRENTDLREEIKVMERFRLDAWKRAEAIESSLEVEKKDKLANTSVRFQ

SEQ ID NO: 679 - protein, 284 aa, Homo sapiens
MEPGNYATLDGAKDIEGLLGAGGGRNLVAHSPLTSHPAAPTLMPAVNYAPLDLPGSAEPPKQCHPCPGVPQGTSPAPVPYGYFGGGYYSCRVSRSSLKPCAQAATLAAYPAETPTAGEEYPSRPTEFAFYPGYPGTYHAMASYLDVSVVQTLGAPGEPRHDSLLPVDSYQSWALAGGWNSQMCCQGEQNPPGPFWKAAFADSSGQHPPDACAFRRGRKKRIPYSKGQLRELEREYAANKFITKDKRRKISAATSLSERQITIWFQNRRVKEKKVLAKVKNSATP

SEQ ID NO: 680 - protein, 676 aa, Homo sapiens
MDKYDDLGLEASKFIEDLNMYEASKDGLFRVDKGAGNNPEFEETRRVFATKMAKIHLQQQQQQLLQEETLPRGSRGPVNGGGRLGPQARWEVVGSKLTVDGAAKPPLAASTGAPGAVTTLAAGQPPYPPQEQRSRPYLHGTRHGSQDCGSRESLATSEMSAFHQPGPCEDPSCLTHGDYYDNLSLASPKWGDKPGVSPSIGLSVGSGWPSSPGSDPPLPKPCGDHPLNHRQLSLSSSRSSEGSLGGQNSGIGGRSSEKPTGLWSTASSQRVSPGLPSPNLENGAPAVGPVQPRTPSVSAPLALSCPRQGGLPRSNSGLGGEVSGVMSKPNVDPQPWFQDGPKSYLSSSAPSSSPAGLDGSQQGAVPGLGPKPGCTDLGTGPKLSPTSLVHPVMSTLPELSCKEGPLGWSSDGSLGSVLLDSPSSPRVRLPCQPLVPGPELRPSAAELKLEALTQRLEREMDAHPKADYFGACVKCSKGVFGAGQACQAMGNLYHDTCFTCAACSRKLRGKAFYFVNGKVFCEEDFLYSGFQQSADRCFLCGHLIMDMILQALGKSYHPGCFRCVICNECLDGVPFTVDSENKIYCVRDYHKVLAPKCAACGLPILPPEGSDETIRVVSMDRDYHVECYHCEDCGLELNDEDGHRCYPLEDHLFCHSCHVKRLEKRPSSTALHQHHF

SEQ ID NO: 681 - protein, 296 aa, Homo sapiens
STGSEFPLCTKASPCSAARAGGRALGWRLQQQRETRGNPGNPGLGVAATMTGSNMSDALANAVCQRCQARFSPAERIVNSNGELYHEHCFVCAQCFRPFPEGLFYEFEGRKYCEHDFQMLFAPCCGSCGEFIIGRVIKAMNNNWHPGCFRCELCDVELADLGFVKNAGRHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCEL

SEQ ID NO: 682 - protein, 500 aa, Homo sapiens
MGIGLSAQGVNMNRLPGWDKHSYGYHGDDGHSFCSSGTGQPYGPTFTTGDVIGCCVNLINNTCFYTKNGHSLGIAFTDLPPNLYPTVGLQTPGEVVDANFGQHPFVFDIEDYMREWRTKIQAQIDRFPIGDREGEWQTMIQKMVSSYLVHHGYCATAEAFARSTDQTVLEELASIKNRQRIQKLVLAGRMGEAIETTQQLYPSLLERNPNLLFTLKVRQFIEMVNGTDSEVRCLGGRSPKSQDSYPVSPRPFSSPSMSPSHGMNIHNLASGKGSTAHFSGFESCSNGVISNKAHQSYCHSNKHQSSNLNVPELNSINMSRSQQVNNFTSNDVDMETDHYSNGVGETSSNGFLNGSSKHDHEMEDCDTEMEVDSSQLRRQLCGGSQAAIERMIHFGRELQAMSEQLRRDCGKNTANKKMLKDAFSLLAYSDPWNSPVGNQLDPIQREPVCSALNSAILETHNLPKQPPLALAMGQATQCLGLMARSGIGSCAFATVEDYLH

SEQ ID NO: 683 - protein, 387 aa, Homo sapiens
MATSGVLPGGGFVASAAAVAGPEMQTGRNNFVIRRNPADPQRIPSNPSHRIQCAAGYEQSEHNVCQDIDECTAGTHNCRADQVCINLRGSFACQCPPGYQKRGEQCVDIDECTIPPYCHQRCVNTPGSFYCQCSPGFQLAANNYTCVDINECDASNQCAQQCYNILGSFICQCNQGYELSSDRLNCEDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 684 - protein, 531 aa, Homo sapiens [sequence omitted]

SEQ ID NO: 685 - protein, 480 aa, Homo sapiens
MAARCSTRWLLVVVGTPRLPAISGRGARPPREGVVGAWLSRKLSVPAFASSLTSCGPRALLTLRPGVSLTGTKHNPFICTASFHTSAPLAKEDYYQILGVPRNASQKEIKKAYYQLAKKYHPDTNKDDPKAKEKFSQLAEAYEVLSDEVKRKQYDAYGSAGFDPGASGSQHSYWKGGPTVDPEELFRKIFGEFSSSSFGDFQTVFDQPQEYFMELTFNQAAKGVNKEFTVNIMDTCERCNGKGNEPGTKVQHCHYCGGSGMETINTGPFVMRSTCRRCGGRGSIIISPCVVCRGAGQAKQKKRVMIPVPAGVEDGQTVRMPVGKREIFITFRVQKSPVFRRDGADIHSDLFISIAQALLGGTARAQGLYETINVTIPPGTQTDQKIRMGGKGIPRINSYGYGDHYIHIKIRVPKRLTSRQQSLILSYAEDETDVEGTVNGVTLTSSGGSTMDSSAGSKARREAGEDEEGFLSKLKKMFTS

SEQ ID NO: 686 - protein, 572 aa, Homo sapiens
MAAPRPSPAISVSVSAPAFYAPQKKFGPVVAPKPKVNPFRPGDSEPPPAPGAQRAQMGRVGEIPPPPPEDFPLPPPPLAGDGDDAEGALGGAFPPPPPPIEESFPPAPLEEEIFPSPPPPPEEEGGPEAPIPPPPQPREKVSSIDLEIDSLSSLLDDMTKNDPFKARVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 687 - protein, 2861 aa, Homo sapiens
MKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRHVRTIWQHRKVRLHQRLQLCVFQQEVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLHVRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGKIVAQGKLLLQDTFLVTDQDAGLLPRCRERRIFLFEQIVIFSEPLDKKKGFSMPGFLFKNSIKVSCLCLEENVENDPCKFALTSRTGDVVETFILHSSSPSVRQTWIHEINQILENQRNFLNALTSPIEYQRNHSGGGGGGGSGAAAGVGAAAAAGPPVAAAATVAAPAAAAAPPARAGAGPPGSPSLSDTTPPCWSPLQPRARQRQTRCQSESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRGRFSVVKKCDQKGTKRAVATKFVNKKLMKRDQVTHELGILQSLQHPLLVGLLDTFETPTSYILVLEMADQGRLLDCVVRWGSLTEGKIRAHLGEVLEAVRYLHNCRIAHLDLKPENILVDESLAKPTIKLADFGDAVQLNTTYYIHQLLGNPEFAAPEIILGNPVSLTSDTWSVGVLTYVLLSGVSPFLDDSVEETCLNICRLDFSFPDDYFKGVSQKAKEFVCFLLQEDPAKRPSAALALQEQWLQAGNGRSTGVLDTSRLTSFIERRKHQNDVRPIRSIKNFLQSRLLPRV

SEQ ID NO: 688 - protein, 271 aa, Homo sapiens
MVLIKEFRVVLPCSVQEYQVGQLYSVAEASKNETGGGEGIEVLKNEPYEKDGEKGQYTHKIYHLKSKVPAFVRMIAPEGSLVFHEKAWNAYPYCRTIVTNEYMKDDFFIKIETWHKPDLGTLENVHGLDPNTWKTVEIVHIDIADRSQVEPADYKADEDPALFQSVKTKRGPLGPNWKKELANSPDCPQMCAYKLVTIKFKWWGLQSKVENFIQKQEKRIFTNFHRQLFCWIDKWIDLTMEDIRRMEDETQKELETMRKRGSVRGTSAADV

SEQ ID NO: 689 - DNA, 11 bp, Homo sapiens
gatgatgatga

SEQ ID NO: 690 - DNA, 11 bp, Homo sapiens
gatgatgatga

SEQ ID NO: 691 - DNA, 11 bp, Homo sapiens
gatgatgatga

SEQ ID NO: 692 - DNA, 11 bp, Homo sapiens
gatgatgatga

SEQ ID NO: 693 - DNA, 11 bp, Homo sapiens
gatgatgatga

SEQ ID NO: 694 - DNA, 11 bp, Homo sapiens
gatgatgatga

SEQ ID NO: 695 - DNA, 11 bp, Homo sapiens
gatgatgatga

SEQ ID NO: 696 - DNA, 11 bp, Homo sapiens
gatgatgatga

SEQ ID NO: 697 - DNA, 11 bp, Homo sapiens
gatgatgatga

SEQ ID NO: 698 - DNA, 11 bp, Homo sapiens
gatgatgatga

SEQ ID NO: 699 - DNA, 11 bp, Homo sapiens
gatgatgatga

SEQ ID NO: 700 - DNA, 11 bp, Homo sapiens
gatgatgatga

SEQ ID NO: 701 - DNA, 11 bp, Homo sapiens
gatgatgatga

SEQ ID NO: 702 - DNA, 11 bp, Homo sapiens
gatgatgatga

SEQ ID NO: 703 - DNA, 11 bp, Homo sapiens
gatgatgatga

SEQ ID NO: 704 - DNA, 11 bp, Homo sapiens
gatgatgatga

SEQ ID NO: 705 - DNA, 11 bp, Homo sapiens
gatgatgatga

SEQ ID NO: 706 - DNA, 11 bp, Homo sapiens
gatgatgatga

SEQ ID NO: 707 - DNA, 11 bp, Homo sapiens
gatgatgatga

SEQ ID NO: 708 - DNA, 11 bp, Homo sapiens
gatgatgatga

SEQ ID NO: 709 - DNA, 11 bp, Homo sapiens
gatgatgatga

SEQ ID NO: 710 - DNA, 11 bp, Homo sapiens
gatgatgatga

SEQ ID NO: 711 - DNA, 11 bp, Homo sapiens
gatgatgatga

SEQ ID NO: 712 - DNA, 11 bp, Homo sapiens
gatgatgatga

SEQ ID NO: 713 - DNA, 11 bp, Homo sapiens
gatgatgatga

SEQ ID NO: 714 - DNA, 11 bp, Homo sapiens
gatgatgatga

SEQ ID NO: 715 - DNA, 11 bp, Homo sapiens
gatgatgatga

SEQ ID NO: 716 - DNA, 11 bp, Homo sapiens
gatgatgatga

SEQ ID NO: 717 - DNA, 11 bp, Homo sapiens
gatgatgatga

SEQ ID NO: 718 - DNA, 11 bp, Homo sapiens
gatgatgatga

SEQ ID NO: 719 - DNA, 11 bp, Homo sapiens
gatgatgatga

SEQ ID NO: 720 - DNA, 11 bp, Homo sapiens
gatgatgatga

SEQ ID NO: 721 - DNA, 11 bp, Homo sapiens
gatgatgatga

SEQ ID NO: 722 - DNA, 11 bp, Homo sapiens
gatgatgatga

SEQ ID NO: 723 - DNA, 11 bp, Homo sapiens
gatgatgatga

SEQ ID NO: 724 - DNA, 11 bp, Homo sapiens
gatgatgatga

SEQ ID NO: 725 - DNA, 11 bp, Homo sapiens
gatgatgatga

SEQ ID NO: 726 - DNA, 11 bp, Homo sapiens
gatgatgatga

SEQ ID NO: 727 - DNA, 11 bp, Homo sapiens
gatgatgatga

SEQ ID NO: 728 - DNA, 11 bp, Homo sapiens
gatgatgatga

SEQ ID NO: 729 - DNA, 11 bp, Homo sapiens
gatgatgatga

SEQ ID NO: 730 - DNA, 11 bp, Homo sapiens
gatgatgatga

SEQ ID NO: 731 - DNA, 11 bp, Homo sapiens
gatgatgatga

SEQ ID NO: 732 - DNA, 11 bp, Homo sapiens
gatgatgatga

SEQ ID NO: 733 - DNA, 11 bp, Homo sapiens
gatgatgatga

SEQ ID NO: 734 - DNA, 11 bp, Homo sapiens
gatgatgatga

SEQ ID NO: 735 - DNA, 11 bp, Homo sapiens
gatgatgatga

SEQ ID NO: 736 - DNA, 21 bp, Homo sapiens
gtcagcctggaggagttctca

SEQ ID NO: 737 - DNA, 22 bp, Homo sapiens
tcacccttggcaatacagatgt

SEQ ID NO: 738 - DNA, 21 bp, Homo sapiens
cccacccatgtgcccgtgaca

SEQ ID NO: 739 - DNA, 19 bp, Homo sapiens
cgtgattgccgacgatctc

SEQ ID NO: 740 - DNA, 19 bp, Homo sapiens
ttccggccgctagtcttgt

SEQ ID NO: 741 - DNA, 26 bp, Homo sapiens
cgcacccgttcggtctgacgcagtac

SEQ ID NO: 742 - DNA, 22 bp, Homo sapiens
ctttccccacgagtatgttggt

SEQ ID NO: 743 - DNA, 19 bp, Homo sapiens
aagggaccgtgctgtgagc

SEQ ID NO: 744 - DNA, 29 bp, Homo sapiens
agcccctcatgtgcctctcaacttcatag

SEQ ID NO: 745 - protein, 6 aa, Artificial Sequence
  partial signal sequence of HBM and Zmax1
SPAHSS

SEQ ID NO: 746 - DNA, 25 bp, Artificial Sequence
  synthetic duplex
tcgaccaccatggaggcagcgccgc

SEQ ID NO: 747 - DNA, 25 bp, Artificial Sequence
  synthetic duplex
ggtggtacctccgtcgcggcgggcc

SEQ ID NO: 748 - DNA, 55 bp, Artificial Sequence
  synthetic duplex
catgtgtgaaatcaccaagccgccctcagacgacagcccggcccacagcagtggc

SEQ ID NO: 749 - DNA, 63 bp, Artificial Sequence
  synthetic duplex
tcgagtacacactttagtggttcggcgggagtctgctgtcgggccgggtgtcgtcaccgccgg

SEQ ID NO: 750 - protein, 17 aa, Artificial Sequence
  peptide from Zmax1 sequence (SEQ ID NO: 3)
VETPRIERAGMDGSTRK

SEQ ID NO: 751 - protein, 15 aa, Artificial Sequence
  peptide from Zmax1 sequence (SEQ ID NO: 3)
NKRTGGKRKEILSAL

SEQ ID NO: 752 - protein, 12 aa, Artificial Sequence
  peptide from Zmax1 sequence (SEQ ID NO: 3)
ERQPFFHTRCEE

SEQ ID NO: 753 - protein, 15 aa, Artificial Sequence
  peptide from Zmax1 sequence (SEQ ID NO: 3)
VDGTKRRTLLEDKLP

SEQ ID NO: 754 - protein, 15 aa, Artificial Sequence
  peptide from Zmax1 sequence (SEQ ID NO: 3)
DGLNDCMHNNGQCGQ

SEQ ID NO: 755 - protein, 12 aa, Artificial Sequence
  peptide from Zmax1 sequence (SEQ ID NO: 3)
PFVLTSLSQGQN

SEQ ID NO: 756 - protein, 15 aa, Artificial Sequence
  peptide from Zmax1 sequence (SEQ ID NO: 3)
YAGANGPFPHEYVSG

SEQ ID NO: 757 - protein, 13 aa, Artificial Sequence
  peptide from Zmax1 sequence (SEQ ID NO: 3)
ACGKSMMSSVSLM

SEQ ID NO: 758 - protein, 18 aa, Artificial Sequence
  peptide from Zmax1 sequence (SEQ ID NO: 3)
RWKASKYYLDLNSDSDPY

SEQ ID NO: 759 - protein, 15 aa, Artificial Sequence
  peptide from Zmax1 sequence (SEQ ID NO: 3)
SGWNECASSNGHCSH

SEQ ID NO: 760 - protein, 14 aa, Artificial Sequence
  peptide from Zmax1 sequence (SEQ ID NO: 3)
NGDANCQDKSDEKN

SEQ ID NO: 761 - protein, 22 aa, Homo sapiens
IKRAKDDGTQPFVLTSLSQGQN

SEQ ID NO: 762 - DNA, 38 bp, Artificial Sequence
  primer
cgtacgtaaagcggccgcttggcaatacagatgtggga

SEQ ID NO: 763 - DNA, 37 bp, Artificial Sequence
  primer
cgtacgtaaagcggccgcagtagctcctctcggtggc

SEQ ID NO: 764 - DNA, 37 bp, Artificial Sequence
  primer
cgtacgtaaagcggccgcgctcatcatggactttccg

SEQ ID NO: 765 - DNA, 37 bp, Artificial Sequence
  primer
cgtacgtaaagcggccgcgcactgctgtttgatgagg

SEQ ID NO: 766 - DNA, 38 bp, Artificial Sequence
  primer
cgtacgtaaagcggccgcgagtgtggaagaaaggctgc

SEQ ID NO: 767 - DNA, 38 bp, Artificial Sequence
  primer
cgtacgtaaagcggccgcagtagagcttcccctcctgc

SEQ ID NO: 768 - DNA, 38 bp, Artificial Sequence
  primer
cgtacgtaaagcggccgcgtccatcacgaagtccaggt

SEQ ID NO: 769 - DNA, 18 bp, Artificial Sequence
  primer
cagcggcctggaggatgc

SEQ ID NO: 770 - DNA, 19 bp, Artificial Sequence
  primer
cggtccagtagaggtttcg

SEQ ID NO: 771 - DNA, 19 bp, Artificial Sequence
  primer
catcagccgcgccttcatg

SEQ ID NO: 772 - DNA, 20 bp, Artificial Sequence
  primer
cctgcatgttggtgaagtac

SEQ ID NO: 773 - DNA, 24 bp, Artificial Sequence
  primer
gcccgaaacctctactggaccgac

SEQ ID NO: 774 - DNA, 24 bp, Artificial Sequence
  primer
gcccaccccatcacagttcacatt

SEQ ID NO: 775 - DNA, 18 bp, Artificial Sequence
  primer
cagcggcctggaggatgc

SEQ ID NO: 776 - DNA, 29 bp, Artificial Sequence
  primer
cgggtacatgtactggacagctgattagc

SEQ ID NO: 777 - DNA, 21 bp, Homo sapiens
gtcagcctggaggagttctca

SEQ ID NO: 778 - DNA, 22 bp, Homo sapiens
tcacccttggcaatacagatgt

SEQ ID NO: 779 - DNA, 21 bp, Homo sapiens
cccacccatgtgcccgtgaca

SEQ ID NO: 780 - DNA, 19 bp, Homo sapiens
cgtgattgccgacgatctc

SEQ ID NO: 781 - DNA, 19 bp, Homo sapiens
ttccggccgctagtcttgt

SEQ ID NO: 782 - DNA, 26 bp, Homo sapiens
cgcacccgttcggtctgacgcagtac

SEQ ID NO: 783 - DNA, 22 bp, Mouse
ctttccccacgagtatgttggt

SEQ ID NO: 784 - DNA, 19 bp, Mouse
aagggaccgtgctgtgagc

SEQ ID NO: 785 - DNA, 29 bp, Mouse
agcccctcatgtgcctctcaacttcatag

SEQ ID NO: 786 - DNA, 20 bp, Artificial Sequence
  primer
gagcgggcagggatggatgg

SEQ ID NO: 787 - DNA, 22 bp, Artificial Sequence
  primer
aggttggcacggtggatgaagc

SEQ ID NO: 788 - DNA, 40 bp, Artificial Sequence
  primer
aagcttgtttaaactgggcatggtggcacatggttgtaat

SEQ ID NO: 789 - DNA, 34 bp, Artificial Sequence
  primer
gggcttccacccagtcagtccagtacatgtacct

SEQ ID NO: 790 - DNA, 30 bp, Artificial Sequence
  primer
ctgactgggtggaagcaccccggatcgagc

SEQ ID NO: 791 - DNA, 33 bp, Artificial Sequence
  primer
gaattcatcggtacctgtgcggccgcttcattg

SEQ ID NO: 792 - DNA, 20 bp, Artificial Sequence
  primer
tgagatgtcctgtctgtggc

SEQ ID NO: 793 - DNA, 20 bp, Artificial Sequence
  primer
tccttccttccctacagttg

SEQ ID NO: 794 - DNA, 25 bp, Artificial Sequence
  primer
cctaaggatctccttgtgtctgtgg

SEQ ID NO: 795 - DNA, 22 bp, Artificial Sequence
  primer
ctgcagcaggtcagtagcctgc

SEQ ID NO: 796 - DNA, 20 bp, Artificial Sequence
  primer
tgagatgtcctgtctgtggc

SEQ ID NO: 797 - DNA, 20 bp, Artificial Sequence
  primer
tccttccttccctacagttg

SEQ ID NO: 798 - DNA, 21 bp, Artificial Sequence
  primer
gcttctggcgtgtgaccggcg

SEQ ID NO: 799 - DNA, 22 bp, Artificial Sequence
  primer
gccgcacagcgccagcagcagc

SEQ ID NO: 800 - DNA, 22 bp, Artificial Sequence
  primer
cacccacgccccacagccagta

SEQ ID NO: 801 - DNA, 24 bp, Artificial Sequence
  primer
atttgccctcccatatgtccttcc

SEQ ID NO: 802 - DNA, 24 bp, Artificial Sequence
  primer
ttcctcccagccctcctccatcag

SEQ ID NO: 803 - DNA, 22 bp, Artificial Sequence
  primer
gccgcacagcgccagcagcagc

SEQ ID NO: 804 - DNA, 19 bp, Artificial Sequence
  primer
gaatggcgcccccgacgac

SEQ ID NO: 805 - DNA, 24 bp, Artificial Sequence
  primer
gctcccattcatcagttccatagg

SEQ ID NO: 806 - DNA, 5278 bp, Mouse
tctagactcgaggcggccgcccattgtgcactaaagcgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactgggttgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtagacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcggccgc

SEQ ID NO: 807 - DNA, 5278 bp, Homo sapiens
tctagactcgaggcggccgcccattgtgcactaaagcgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtagacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcggccgc

SEQ ID NO: 808 - protein, 1615 aa, Homo sapiens
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEADCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 809 - protein, 1564 aa, Mouse
METAPTRAPPPPPPPLLLLVLYCSLVPAAASPLLLFANRRDVRLVDAGGVKLESTIVASGLEDAAAVDFQFSKGAVYWTDVSEEAIKQTYLNQTGAAAQNIVISGLVSPDGLACDWVGKKLYWTDSETNRIEVANLNGTSRKVLFWQDLDQPRAIALDPAHGYMYWTDWGEAPRIERAGMDGSTRKIIVDSDIYWPNGLTIDLEEQKLYWADAKLSFIHRANLDGSFRQKVVEGSLTHPFALTLSGDTLYWTDWQTRSIHACNKWTGEQRKEILSALYSPMDIQVLSQERQPPFHTPCEEDNGGCSHLCLLSPREPFYSCACPTGVQLQDNGKTCKTGAEEVLLLARRTDLRRISLDTPDFTDIVLQVGDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIVLHPVMGLMYWTDWGENPKIECANLDGRDRHVLVNTSLGWPNGLALDLQEGKLYWGDAKTDKIEVINIDGTKRKTLLEDKLPHIFGFTLLGDFIYWTDWQRRSIERVHKVKASRDVIIDQLPDLMGLKAVNVAKVVGTNPCADGNGGCSHLCFFTPRATKCGCPIGLELLSDMKTCIIPEAFLVFTSRATIHRISLETNNNDVAIPLTGVKEASALDFDVSNNHIYWTDVSLKTISRAFMNGSSVEHVIEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERMVIADDLPYPFGLTQYSDYIYWTDWNLHSIERADKTSGRNRTLIQGHLDFVMDILVFHSSRQDGLNDCVHSNGQCGQLCLAIPGGHRCGCASHYTLDPSSRNCSPPSTFLLFSQKFAISRMIPDDQLSPDLVLPLHGLRNVKAINYDPLDKFIYWVDGRQNIKRAKDDGTQPSMLTSPSQSLSPDRQPHDLSIDIYSRTLFWTCEATNTINVHRLDGDAMGVVLRGDRDKPRAIAVNAERGYMYFTNMQDHAAKIERASLDGTEREVLFTTGLIRPVALVVDNALGKLFWVDADLKRIESCDLSGANRLTLEDANIVQPVGLTVLGRHLYWIDRQQQMIERVEKTTGDKRTRVQGRVTHLTGIHAVEEVSLEEFSAHPCARDNGGCSHICIAKGDGTPRCSCPVHLVLLQNLLTCGEPPTCSPDQFACTTGEIDCIPGAWRCDGFPECADQSDEEGCPVCSASQFPCARGQCVDLRLRCDGEADCQDRSDEANCDAVCLPNQFRCTSGLFVMGGVYFVCQRVMCQRYTGASGPFPHEYVGGAPHVPLNFIAPGGSQHGPFPGIPCSKSVMSSMSLVGGRGSVPLYDRNHVTGASSSSSSSTKATLYPPILNPPPSPATDPSLYNVDVFYSSGIPATARPYRPYVIRGMAPPTTPCSTDVCDSDYSISRWKSSKYYLDLNSDSDPYPPPPTPHSQYLSAEDSCPPSPGTERSYCHLFPPPPSPCTDSS

SEQ ID NO: 810 - protein, 1665 aa, Homo sapiens
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNFSQKSAINRMVIDEQQSPDIILPIHSLRNVRAIDYDPLDKQLYWIDSRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEADCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 811 - protein, 1613 aa, Homo sapiens
MGAVLRSLLACSFCVLLRAAPLLLYANRRDLRLVDATNGKENATIVVGGLEDAAAVDFVFSHGLIYWSDVSEEAIKRTEFNKTESVQNVVVSGLLSPDGLACDWLGEKLYWTDSETNRIEVSNLDGSLRKVLFWQELDQPRAIALDPSSGFMYWTDWGEVPKIERAGMDGSSRFIIINSEIYWPNGLTLDYEEQKLYWADAKLNFIHKSNLDGTNRQAVVKGSLPHPFALTLFEDILYWTDWSTHSILACNKYTGEGLREIHSDIFSPMDIHAFSQQRQPNATNPCGIDNGGCSHLCLMSPVKPFYQCACPTGVKLLENGKTCKDGATELLLLARRTDLRRISLDTPDFTDIVLQLEDIRHAIAIDYDPVEGYIYWTDDEVRAIRRSFIDGSGSQFVVTAQIAHPDGIAVDWVARNLYWTDTGTDRIEVTRLNGTMRKILISEDLEEPRAIVLDPMVGYMYWTDWGEIPKIERAALDGSDRVVLVNTSLGWPNGLALDYDEGKIYWGDAKTDKIEVMNTDGTGRRVLVEDKIPHIFGFTLLGDYVYWTDWQRRSIERVHKRSAEREVIIDQLPDLMGLKATNVHRVIGSNPCAEENGGCSHLCLYRPQGLRCACPIGFELISDMKTCIVPEAFLLFSRRADIRRISLETNNNNVAIPLTGVKEASALDFDVTDNRIYWTDISLKTISRAFMNGSALEHVVEFGLDYPEGMAVDWLGKNLYWADTGTNRIEVSKLDGQHRQVLVWKDLDSPRALALDPAEGFMYWTEWGGKPKIDRAAMDGSERTTLVPNVGRANGLTIDYAKRRLYWTDLDTNLIESSNMLGLNREVIADDLPHPFGLTQYQDYIYWTDWSRRSIERANKTSGQNRTIIQGHLDYVMDILVFHSSRQSGWNECASSNGHCSHLCLAVPVGGFVCGCPAHYSLNADNRTCSAPTTFLLFSQKSAINRMVIDEQQSPDIILPIHSLRNVRAIDYDPLDKQLYWIDSRQNMIRKAQEDGSQGFTVVVSSVPSQNLEIQPYDLSIDIYSRYIYWTCEATNVINVTRLDGRSVGVVLKGEQDRPRAIVVNPEKGYMYFTNLQERSPKIERAALDGTEREVLFFSGLSKPIALALDSRLGKLFWADSDLRRIESSDLSGANRIVLEDSNILQPVGLTVFENWLYWIDKQQQMIEKIDMTGREGRTKVQARIAQLSDIHAVKELNLQEYRQHPCAQDNGGCSHICLVKGDGTTRCSCPMHLVLLQDELSCGEPPTCSPQQFTCFTGEIDCIPVAWRCDGFTECEDHSDELNCPVCSESQFQCASGQCIDGALRCNGDANCQDKSDEKNCEVLCLIDQFRCANGQCIGKHKKCDHNVDCSDKSDELDCYPTEEPAPQATNTVGSVIGVIVTIFVSGTVYFICQRMLCPRMKGDGETMTNDYVVHGPASVPLGYVPHPSSLSGSLPGMSRGKSMISSLSIMGGSSGPPYDRAHVTGASSSSSSSTKGTYFPAILNPPPSPATERSHYTMEFGYSSNSPSTHRSYSYRPYSYRHFAPPTTPCSTDVCDSDYAPSRRMTSVATAKGYTSDLNYDSEPVPPPPTPRSQYLSAEENYESCPPSPYTERSYSHHLYPPPPSPCTDSS

SEQ ID NO: 812 - protein, 207 aa, Artificial Sequence
  cytoplasmic domain and portion of transmembrane domain
RVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATVRPYRPYIIRGMAPPTTPCSTDVCDSDYSASRWKASKYYLDLNSDSDPYPPPPTPHSQYLSAEDSCPPSPATERSYFHLFPPPPSPCTDSS

What is claimed is:

1. A transgenic mouse having somatic and germ cells comprising a stably integrated nucleic acid which comprises a murine or viral promoter region that directs protein expression in transgenic mouse bone cells that is operably linked to a sequence encoding a human HBM protein or a sequence encoding a mouse LRP5 protein having a glycine 170 to valine substitution, and wherein said transgenic mouse has increased bone density.

2. A transgenic mouse having somatic and germ cells comprising a stably integrated nucleic acid which comprises SEQ ID NO: 2 or a mouse nucleic acid encoding an LRP having a glycine 170 to valine substitution, and wherein the nucleic acid further comprises an operably linked murine or viral promoter region that directs protein expression in mouse bone cells, and wherein bone mass is increased relative to non-transgenic mice in more than one parameter selected from among bone density, bone strength, trabecular number, bone size, and bone tissue connectivity.

3. The transgenic mouse of claim 1, wherein the nucleic acid comprises SEQ ID NO: 2.

4. A transgenic mouse for the study of bone density modulation having somatic and germ cells comprising a stably integrated nucleic acid which comprises a murine or viral promoter region that directs protein expression in mouse bone cells, wherein the promoter region is operably linked to a sequence encoding SEQ ID NO: 4 or a sequence encoding a mouse LRP5 protein having a glycine 170 to valine substitution, wherein bone mass is increased relative to non-transgenic mice in more than one parameter selected from among bone density, bone strength, trabecular number, bone size, and bone tissue connectivity.

5. The transgenic mouse of claim 1, wherein the promoter region is a bone specific promoter region.

6. The transgenic mouse of claim 4, wherein the promoter region is a bone specific promoter region.

7. The transgenic mouse of claim 1, wherein the promoter region is a CMVβActin promoter region.

8. The transgenic mouse of claim 1, wherein the promoter region is a type I collagen promoter region.

9. The transgenic mouse of claim 1, wherein the transgenic mouse expresses SEQ ID NO: 4.

10. The transgenic mouse of claim 1, wherein bone mass is increased relative to a wild-type mouse in more than one parameter selected from among bone density, bone strength, trabecular number, bone size, and bone tissue connectivity.

11. The transgenic mouse of claim 1, wherein a human HBM protein is expressed, and wherein the transgenic mouse is fertile and passes to its offspring the nucleic acid encoding SEQ ID NO: 4.

12. The transgenic mouse of claim 4, wherein SEQ ID NO: 4 is expressed, and wherein the transgenic mouse is fertile and passes to its offspring the nucleic acid encoding SEQ ID NO: 4.

13. The transgenic mouse of claim 1, wherein the murine or viral promoter region is selected from the group consisting of CMV, RSV, SV40, EF-1a, histone, TGFβ1, MSX2, c-fos/c-jun, Cbfa1, Fra/Jun, D1x5, osteocalcin, osteopontin, bone sialoprotein, collagenase, alkaline phosphatase, and MGP.

14. A transgenic mouse having somatic and germ cells comprising a stably integrated nucleic acid which comprises a viral or murine bone-specific promoter region that directs protein expression in mouse bone cells that is operably linked to a sequence encoding SEQ ID NO: 4 or a sequence encoding a mouse LRP5 protein having a glycine 170 to valine substitution, and wherein bone mass is increased relative to non-transgenic mice in more than one parameter selected from among bone density, bone strength, trabecular number, bone size, and bone tissue connectivity.

15. The transgenic mouse of claim 1, wherein the sequence comprises SEQ ID NO: 2; the murine or viral promoter region is selected from the group consisting of CMV, RSV, SV40, EF-1a, histone, TGFBB1, MSX2, c-fos/c-jun, Cbfa1, Fra/Jun, D1x5, osteocalcin, osteopontin, bone sialoprotein, collagenase, alkaline phosphatase, and MGP, and wherein the transgenic mouse has increased bone density as compared to non-transgenic mice.

* * * * *